United States Patent 6,943,241 (FULL-LENGTH CDNA) - sequence listing, part 3

SEQ ID NO: 3412 - protein, 383 aa, Homo sapiens
MISSIVISQMIDENKSRENRASLPLPCAIAQSRAHHAKQSLANRSGVNIHRAFALLPGRLGIPAPSDERGPEAELPPKEERPCGGPHRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRVSQQCPNSIYYVDKSLSVPIEPPQIASPKMHRSVLSLNLNCSSHRLTADGVDGLVNREPISEALKQELLEGDQDLVGQRWNPGLQESHLKETPSLRRVHLGTGACPWSGSFPLENTELANVGANQVTVRKGEKDHTTHCHASDHANQLSIHIPGWSYRADLLQEGQHKQLSMFQR

SEQ ID NO: 3413 - protein, 395 aa, Homo sapiens
MESKRPRLLEEADKQKKTVRVGLNAPSMLRKNQLGFLRFANYCRIARELRVSCMQRKKVQIHSWDPSSLASDRFNRILANTNTDQLFTVNQVEAGGSKYGIITMRGLTTPELRVYPHKTLYVPNRKVNSMCWASLNHLDSHLLLCFVGLADTPSCAVLLPASLFIGSFPGMRRPGMLCSFQIPDAWSCAWSLSIHAYHSFSTGLSQQVLLTNVVTGHQQSFGTSSDVLAQQFAIMTPLLFNGCRSGEIFGIDLRCGNQGSGWKAICLSHDSAVTSLQILQDGQFLVSSDMTGTIKLWDLRATKCVTQYEGHVNNSAYLPVHVNEEEGVVAAVGQDCYTRIWSLRHGHLLTTIPSPYPASENDIPSVAFSSRLGGFRGAPGLLMAVREDLYCFSYG

SEQ ID NO: 3414 - protein, 128 aa, Homo sapiens
MSCHQSPLVFDVGQCRQHDLAGQILIYHSLTPAGPLGRPPDVPHSPHLASPTGSRQRTVGGTCDTALFLCSCFSSSFFSLLVTLFFFTLSPHKTRNFVILLIFLYSVCLHTDGYLRASELSLPPSIIS

SEQ ID NO: 3415 - protein, 590 aa, Homo sapiens
MKSKVDTIVNFTHQHFTSQFEVTVWAPRLPLQIEISDTELSQIKGWRIPVAANRRPTRESDDEDDEEKKGRGCSLQYQHATVRVLTQFVAESPDLGQLTYMLGPDWQFDITDLVTEFMKVEEPKIAQLQDGRTLAGREPGITTVQVLSPLSDSILAEKTVIVLDDRVTIAELGVQLVAGMSLSLQPHRADKRAIVSTAAALDVLQSPQQEAIVSSWILFSDGSVTPLDIYDPKDYSVTVSSLDEMVGSVQANLESKWPIVVAEGEGQGPLIKLEMMISEPCQKTKRKSVLAVGKGNVKVKFEPSSDEHQGGSNDIEGINREYKDHLSNSIEREGNQERAVQEWFHRGTPVGQEESTNKSTTPQSPMEGKNKLLKSGGPDAFTSFPTQGKSPDPNNPSDLTVTSRGLTDLEIGMYALLCVFCLAILVFLINCVAFAWKYRHKRFAVSEQGNIPHSHDWVWLGNEVELLEDPVDITLPSEECTTMIDRGLQFEERNFLLNGSSQKTFHSQLLRPSDYVYEKEIKNEPMNSSGPKRKRVKFTSYTTILPEDGGPYTNSILFDSDDNIKWVCQDMGLGDSQDFRDYMESLQDQM

SEQ ID NO: 3416 - protein, 550 aa, Homo sapiens
MKWEEYEELLHYAIVTPNIEPRASQSSHPKGELVPDVRISTIHDILHSQGNNSEVRETAIEVGKGCDFHISSHSKTDESSPVLSPRKPSHPVMDFFSSHLLADSSSPATNSSHTDAHEILVSDFLVSDENLQKMENVLDLWSSGLKTNIISELSKWRLNFIDWHRMEMRKEKEKHAAHLKQLCNQINELKELQKTFEISIGRKDEVISSLSHAIGKQKEKIELMRTFFHWRIGHVRARQDVYEGKLADQYYQRTLLKKVWKVWRSVVQKQWKDVVERACQARAEEVCIQISNDYEAKVAMLSGALENAKAEIQRMQHEKEHFEDSMKKAFMRGVCALNLEAMTIFQNRNDAGIDSTNNKKEEYGPGVQGKEHSAHLDPSAPPMPLPVTSPLLPSPPAAVGGASATAVPSAASMTSTRAASASSVHVPVSALGAGSAATAASEEMYVPRVVTSAQQKAGRTITARITGRCDFASKNRISSSLAIMGVSPPMSSVVVEKHHPVTVQTIPQATAAKYPRTIHPESSTSASRSLGTRSAHTQSLTSVHSIKVVD

SEQ ID NO: 3417 - protein, 418 aa, Homo sapiens
MNQSQNEELSPLVPVETRASLIPEHSSPVQDCQISQESEPVIQVNSWVGINSNDDQLFAVKNNFPASVHTTRYSRNDLHLEDIQTDEDKLNCSLFSSESTFMPVASGLSPLSPTVELRLQGINLGLEDDGVADESVKGLESQVLDKEEEQPLWAANENSVQMMRSEINTEVNEKAGLLPCPEPTIISAILKDDNHSLTFFPESTEQKQSDIKKPENTQPENKETISQATSEKLPMILTQRSVALGQDKVALQKLNDAATKLQACWRGFYARNYNPQAKDVRYEIRLRRMQEHIVCLTDEIRRLRKERDEERIKKFVQEEAFRFLWNQKWGLAILPRPVSNFWAQAVFPPQPPKVRSLQVWQQTVDQRLSSWHTDVPPISSTLVPSKHPLFTQSQESSCDQNADWFIASDVAPQEKSLP

SEQ ID NO: 3418 - protein, 645 aa, Homo sapiens
MGDRRPQDRPRSQGMDSKPWYCDKPPSKYFAKRKHRRLRFPPVDTQNWVFVTEGMDDFRYACQSPEDTLVCRRDEFLLPKISLRGPQADRKSRKKKLLKKAALFSELSPVQPARKAFVEEVEAQLMTKHPLAMYPNLGKDMPPDLLLQVLKQLDPERKLEDAWARCEAREKTTEVPTESGKYPCGESCPRPPETPVSRLRPQLPKTPVSSRRPEPPKTRAPSLRPEPPKTRVSSLHPEPPETRASHLRVDPPETGVSHLCPEPPKTLVSSVHPEPPDTGASHLCPEPPETRVSHLHPESPETGVSHLRPEPSKTQVSSLCPEPPEAGVSHLCLEPPNTHRVSSFLLQVLKLDSEKKLEDARARCEGQEMTTEELTKPGKYHFWESCPRPFESRMPHLRLVLPITRRMASLCLKPPKTRRVSSLCPEPTKTGASHLKELFQEDTPSTMECVSDSLQRRHTSRKLRDFKWAGDLGVNEESISSLFDFTPECRTTDQDQKIKKANECASRLMYGMELDDMDEVEFLRIKYWDRRRRAAPHSYSAQRGRIRYGPWYFEPKLGKKLRSDEPLIDPKPVLEKPDEPDILDGLYGPIAFKDFILSKGYRMPGVIEKLFAKKGWTYDSVKTPIQRAVQVYKYKEDVTDASKED

SEQ ID NO: 3419 - protein, 485 aa, Homo sapiens [sequence omitted]

SEQ ID NO: 3420 - protein, 505 aa, Homo sapiens [sequence omitted]

SEQ ID NO: 3421 - protein, 371 aa, Homo sapiens
MGGPVLGHWWHSGGMSLAVPSLPPPGKSSVFLFLQEKKANIKKQKAKRVLEVQIQTLNIQKEELNTDLYHMKRSLRYFEEKSKDLAVRLQHSLQRKGELESVLSDVMATQKKKANQLSSPSKAGTEWKLEQSMREEALLKVQLTQLKESFQQLQLERHEYAEHLKGERARWQQRMRKMSQEICTLKKEKQQDMRRVEKLERSLSKLKNQMAEPLPPEPPAVPSEVELQHLRKELERVAGALQAQVKNNQRISLLNRGQEERIREQEERLRKQEERIQEQHKSLQQLAKPQSVFEEPNNENKSALQLEQQVKELQEKLGEVKESETSTPSKKGWEAGSSLWGGEVPGQRQLPAWGLVTTAPPRAVLFLASCL

SEQ ID NO: 3422 - protein, 110 aa, Homo sapiens [sequence omitted]

SEQ ID NO: 3423 - protein, 575 aa, Homo sapiens
MDPEDEGVAGVMSVGPPAARLQEPVTFRDVAVDFTQEEWGQLDPTQRILYRDVMLETFGHLLSIGPELPKPEVISQLEQGTELWVAERGTTQGCHPAWEPRSESQASRKEEGLPEEEPSHVTGREGFPTDAPYPTTLGKDRECQSQSLALKEQNNLKQLEFGLKEAPVQDQGYKTLRLRENCVLSSSPNPFPEISRGEYLYTYDSQITDSEHNSSLVSQQTGSPGKQPGENSDCHRDSSQAIPITELTKSQVQDKPYKCTDCGKSFNHNAHLTVHKRIHTGERPYMCKECGKAFSQNSSLVQHERIHTGDKPYKCAECGKSFCHSTHLTVHRRIHTGEKPYECQDCGRAFNQNSSLGRHKRTHTGEKPYTCSVCGKSFSRTTCLFLHLRTHTEERPYECNHCGKGFRHSSSLAQHQRKHAGEKPFGCRQRLIFEQTPALTKHEWTEALGCDPPLSQDERTHRSDRPFKCNQCGKCFIQSSHLIRHQITHTREEQPHGRSRRREQSSSRNSHLVQHQHPNSRKSSAGGAKAGQPESRALALFDIQKIMQEKNPVHVIGVEEPSVGASMLFDIREST

SEQ ID NO: 3424 - protein, 341 aa, Homo sapiens
MDLYVGRFKLAELMFLDVSYNRIPSMPMHHINLVPGKQLRGIYLHGNPFVCDCSLYSLLVFWYRRHFSSVMDFKNDYTCRLWSDSRHSRQVLLLQDSFMNCSDSIINGSFRALGFIHEAQVGERLMVHCDSKTGNANTDFIWVGPDNRLLEPDKEMENFYVFHNGSLVIESPRFEDAGVYSCIAMNKQRLLNETVDVTINVSNFTVSRSHAHEAFNTAFTTLAACVASIVLVLLYLYLTPCPCKCKTKRQKNMLHQSNAHSSILSPGPASDASADERKAGAGKRVVFLEPLKDTAAGQNGKVRLFPSEAVIAEGILKSTRGKSDSDSVNSVFSDTPFVAST

SEQ ID NO: 3425 - protein, 363 aa, Homo sapiens
MWATCCNWFCLDGQPEEVPPPQGARMQAYSNPGYSSFPSPTGLEPSCKSCGAHFANTARKQTCLDCKKNFCMTCSSQVGNGPRLCLLCQRFRATAFQREELMKMKVKDLRDYLSLHDISTEMCREKEELVLLVLGQQPVISQEDRTRASTLSPDFPEQQAFLTQPHSSMVPPTSPNLPSSSAQATSVPPAQVQENQQANGHVSQDQEEPVYLESVARVPAEDETQSIDSEDSFVPGRRASLSDLTDLEDIEGLTVRQLKEILARNFVNYKGCCEKWELMERVTRLYKDQKGLQHLVSGAEDQNGGAVPSGLEENLCKICMDSPIDCVLLECGHMVTCTKCGKRMNECPICRQYVIRAVHVFRS

SEQ ID NO: 3426 - protein, 552 aa, Homo sapiens
MEILVEPVTLPCNHTLCKPCFQSTVEKASLCCPFCRRRVSSWTRYHTRRNSLVNVELWTIIQKHYPRECKLRASGQESEEVADDYQPVRLLSKPGELRREYEEEISKVAAERRASEEEENKASEEYIQRLLAEEEEEEKRQAEKRRRAMEEQLKSDEELARKLSIDINNFCEGSISASPLNSRKSDPVTPKSEKKSKNKQRNTGDIQKYLTPKSQFGSASHSEAVQEVRKDSVSKDIDSSDRKSPTGQDTEIEDMPTLSPQISLGVGEQGADSSIESPMPWLCACGAEWYHEGNVKTRPSNHGKELCVLSHERPKTRVPYSKETAVMPCGRTESGCAPTSGVTQTNGNNTGETENEESCLLISKEISKRKNQESSFEAVKDQCFSAKRRKVSPESSPDQEETEINFTQKLIDLEHLLFERHKQEEQDRLLALQLQKEVDKEQMVPNRQKGSPDEYHLRATSSPPDKVLNGQRKNPKDGNFKRQTHTKHPTPERGSRDKNRQVSLKMQLKQSVNRRKMPNSTRDHCKVSKSAHSLQPSISQKSVFQMFQRCTK

SEQ ID NO: 3427 - protein, 447 aa, Homo sapiens
MGLSFFSKHLPIQEGQPWALKTPADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 3428 - protein, 326 aa, Homo sapiens
MRECISIHVGQAGVQIGNACWELYCLEHGIQPDGQMPSDKTIGGGDDSFNTFFSETGAGKHVPRAVFVDLEPTVVDEVRTGTYRQLFHPEQLIPGKEDAANNYARGHYTIGKEIVDLVLDRIRKLADLCTGLQGFLIFHSFGGGTGSGFASLLMERLSVDYGKKSKLEFAIYPAPQVSTAVVEPYNSILTTHTTLEHSDCAFMVDNEAIYDICRRNLDIERPTYTNLNRLIGQIVSSITASLRFDGALNVDLTEFQTNLVPYPRIHFPLATYAPKTSTRPSPPSRPSAPSSLWIGARLDLRWALTTSPPQWSPGETWPRCSGPCAC

SEQ ID NO: 3429 - protein, 311 aa, Homo sapiens
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQLSASRMTLCSPLV

SEQ ID NO: 3430 - protein, 101 aa, Homo sapiens
MKQAEVGKSRPAESSGPHRSPVLDSSGPQTSDSTFFSFWTHGLTPVVCQGLLSLWSQTEGYTVSFSNFEVLGLRLIHHWLPCSSTCRWLLTGLDFMIILGQ

SEQ ID NO: 3431 - protein, 160 aa, Homo sapiens
MLPEMKRESRMAEESPAQETPRLGQSSSRRGQGLSVYYSKQASPRDVVWEGPKPTRQAHPVGKRLPIPVWPASLTSASQSSADLRGAGWPLLIWVREMPETHPGLNHRLVVQSHSPCAFRKPRGPKYEWEESWEKLNQTLPMAIKEKIQQRLPLSLTLRS

SEQ ID NO: 3432 - protein, 436 aa, Homo sapiens
MPMSSLPAAILSHMTAINNVPPPPLHSIPNLKKSKHINYGQLNALCHIRGQHSRSMSNILSAHDTFMKQYPKVFLHQKPRLPKLFKQEEQRELNEGKEESQHQQPDDSNNIAVHVQRAHGGHILYRPKRATEKFEEFLAILKKLPIHRTPYEHKTVWKFLKTIPDLTFQLNDKHLKTLSKTVFSETWLKGSTVVANDGFYVILKGLARPQTNVYKNLIEGSDSPDSFISQSFHSFIWSEEFKNSTLAEMYLPSYDSMLSKWSTFGTLEVMPQNESETQMFSVVTEDDCEILKIPAKGYAKIKEEKIKLENMQKLKLIRMCPYYEEWPTLSIYELIALLKWKKFPPGHVIVESGNIISFVGYINSGCCNIYRSIIGFVKLRSNKVKRSQKLVYMGKLKEKESFGEISVLLQVPFTCTIITKKEVEMAIIEDKDLFVA

SEQ ID NO: 3433 - protein, 377 aa, Homo sapiens
MFWRRLRPGAQDLAPKGLPGDGDFRRSSDPRLPKLTPPALRAALGARGSGDWRIPGGGAAWWPEGDAKPGVGVGRLPPRLPALLTATRRAVRKRGLLRSLLPPPLLSAGASRESAPRQPGPGERERPRRRVAREDPDFLGAFLGELLPSRFREFLHQLQEKCTEEPEPLTSPAPQHQRGVLEHCPGSPRCPNCSFLPDLWGQSSHLQDSLTKISLQQTPILGPLKGDHSQFTTVRKANHRPHGAQVPRLKAALTHNPSGEGSRPCRQRCPFRVRFADETLQDTTLRYWERRRSVQQSVIVNQKAALPVASERVFGSVGKRLESLPKALYPGAKEETLASSSCWDCAGLSTQKTQGYLSEDTSMNSSLPFCSWKKAAA

SEQ ID NO: 3434 - protein, 530 aa, Homo sapiens
MKPAQRNLYRDVMLENYSNLVTVGCQVTKPDVIFKLEQEEEPWVMEEEMFGRHCPEVWEVDEQIKKQQETLVRKVTSISKKILIKEKVIECKKVAKIFPLSSDIVTSRQSFYDCDSLDKGLEHNLDLLRYEKGCVREKQSNEFGKPFYHCASYVVTPFKCNQCGQDFSHKFDLIRHERIHAGEKPYECKECGKAFSRKENLITHQKIHTGEKPYKCNECGKAFIQMSNLIRHHRIHTGEKPYACKDCWKAFSQKSNLIEHERIHTGEKPYECKECGKSFSQKQNLIEHEKIHTGEKPYACNECGRAFSRMSSVTLHMRSHTGEKPYKCNKCGKAFSQCSVFIIHMRSHTGEKPYVCSECGKAFSQSSSLTVHMRNHTAEKPYECKECGKAFSRKENLITHQKIHTGEKPYECSECGKAFIQMSNLIRHQRIHTGEKPYACTVCGKAFSQKSNLTEHEKIHTGEKPYHCNQCGKAFSQRQNLLEHEKIHTGEKPFKCNECGKAFSRISSLTLHVRSHTGEKPYECNKCGKA

SEQ ID NO: 3435 - protein, 228 aa, Homo sapiens [sequence omitted]

SEQ ID NO: 3436 - protein, 426 aa, Homo sapiens
MRIEEAKGFRAVQLKKTETYEKENCGGFRLIYPSLNSEKYEKFFQDNNSLFQNTVASRAREEYARQLIQELRLKREKKPFQMKKKVEMQGESAGEQVRKKGMRGWQQKQQQKDKAATQASKQYIQPLTLVSYTPDLLLSVRGERKNETDSSLNQEAPTEEASSVFPKLTSAKPFSSLPDLRNINLSSSKLEPSKPNFSIKEAKSASAVNVFTGTVHLTSVETTPESTTQLSISPKSPPTLAVTASSEYSGPETDRVVSFKCKKQQTPPHLTQKKMLKSFLPTKSKSFWESPNTNWTLLKSDMNKPHLISELLTKLQLSGKLSFFPAHYNPKLGMNNLSQNPSLPGECHSRSDSSGEKRQLDVSSLLLQSPQSYNVTLRDLLVIATPAQLDPRPCRSHASAMRDPCMQDQEAYSHCLISGQKGCERS

SEQ ID NO: 3437 - protein, 448 aa, Homo sapiens
MSPLECSECFGDQLLHRTYTWQLTLHSRPNYTRKRDTRSESLEIPISVVLPQRGTAEPFPRLHNLYSTPRCAQQAALPRLSRRMASQHSYPLNRFSSVPLDPMERPMSQADLELDYNPPRVQLSDEMFVFQDGRWVNENCRLQSPYFSPSASFHHKLHHKRLAKECMLQEENKSLREENKALREENRMLSKENKILQVFWEEHKASLGREESRAPSPLLHKDSASLEVVKKDHVALQVPRGKEDSTLQLLREENRALQQLLEQKQAYWAQAEDTAAPAEESKPAPSPHEEPCSPGLLQDQGSGLSSRFEEPKGPPARQEDSKELRALRKMVSNMSGPSGEEEAKVGPGLPDGCQPLQLLREMRQALQALLKENRLLQEENRTLQVLRAEHRGFQEENKALWENNKLKLQQKLVIDTVTEVTARMEMLIEELYAFMPARSQDPKKPSRV

SEQ ID NO: 3438 - protein, 148 aa, Homo sapiens
MKWFHENLSPGKPISDSPLGLVPVEKKAVGAVMRKRKHMDEPSSPSRPGLDRAKIGTSSQGPSKKKPPVETRRNRERKTQQGLQETLASDITDVQKQDSEWGHSLPGRIVPPLQHNSPPPKERAATGFFGFLSSLFPFRYFFRKSSHS

SEQ ID NO: 3439 - protein, 829 aa, Homo sapiens [sequence omitted]

SEQ ID NO: 3440 - protein, 138 aa, Homo sapiens
MEQKAWICSWDLGGASACSVEQEVWVYSCDFSGCSCAQESGAPICSRPESTGMPKSAESYHPTRKGQGSCLSAAPASSMEHAALAVPPCCSWHDGTSHFRWTVVSSLRPCLDTAVRTLSSHTCLPAASAAVAQVAAVP

SEQ ID NO: 3441 - protein, 518 aa, Homo sapiens [sequence omitted]

SEQ ID NO: 3442 - protein, 531 aa, Homo sapiens
MDVGADEFEESLPLLQELVQEADFVGLDIEFTGLRSNLSGPQQISLFDLPSEWYLKTRQSVQQFTVCQIGLSVFSAIEGEANKYIAHSCNFYLFPTTFGILDSEFSFQASSVQFLNQYGFNYNKFLKNGIPYMNEEQEKKIRHDILTGNWRVRSSPDKDQIKVVIDEVTRWLELAKEGDWMTLPGITGFQAFEVQLVLRQALPNIWTVLKDEGVVVKKVSKQHRWYLQNTSCDRESCWKENILLSARGFSVFFQMLVKAQKPLVGHNMMMDLLHLHEKFFRPLPESYDQFKQNIHSLFPVLIDTKSVTKDIWKEMNFPRVSNLSEVYEVLNSDLNPTKNSGPEIVHASRCEKYVETKCPHEAAYDAFLCGSVLLKVAHLLLQKIYHIDPVPESSFPQYLDVLAPYVNQVNLIRAGVPKINFSGPDYPSIRPPILILSVKRWPGVSEQQVYHKFQNLCKFDVRRLTRSQFLLLTNKFKDARNILKEYRDHPTLCISLYRYWRHSPNVNCLLQVCGIVTAWALLAFILGRSGT

SEQ ID NO: 3443 - protein, 414 aa, Homo sapiens
MEMQQNCSISCFWETQPLGCVKISCIFYHSKPRNINGLFLPPSSNITLQKEIQEGIPLQSQSQEPLKPQENISRPIHHPLVLKTNFEEEEEVDEQNDASSLWTKTPEEIEEKRAIKEMCYKSGEYYRFHTPPDILSSKSMTPTAEKQLEKPLENGSELQEGDSLTVPTKLSQYERQGEIKTSLHGKPKTDIAAFENGGGDCYVPQRVIFLGVDESEALTEEKEITISKCSNTKDNKDSPHPKHSLTTRLVPTTHVLNATENISMKCREDPSSMNDVQPVKKPHFKGVKKRKWIYDEPQNFPNSGMQRAVQAPRPQNKMSYHRNNKNRNAENASYIHVQRDAVRTVALNAPSRSRPTHGSYNKVHANREPKPNLSPDKYTSTSYNDSAWRKRIPFSKTYSKSEKIYPEPRRNGSK

SEQ ID NO: 3444 - protein, 100 aa, Homo sapiens [sequence omitted]

SEQ ID NO: 3445 - protein, 114 aa, Homo sapiens [sequence omitted]

SEQ ID NO: 3446 - protein, 108 aa, Homo sapiens
MWADSVVCCSFSHGLPSCSYSCTYSTQEWHSFVSRKARTSSLLILAILSQIRLRICCICIFVLNNNSSSFSELGIYVFCLLCTNDLKTAFYPLDKFSNSLCFLVPSIS

SEQ ID NO: 3447 - protein, 136 aa, Homo sapiens
MFKSTVHKEVSVFFFFFEMESRSIARLECSGAISAHCNLHLLGSSDSLASASRVAGTTGACHHARLIFCIFSRDEISPCWPGWSRSLDLVIHTPLGFPKCWDYRCEPPCQAMSVFLDYIVIKVRDCALLEKNSYNS

SEQ ID NO: 3448 - protein, 501 aa, Homo sapiens [sequence omitted]

SEQ ID NO: 3449 - protein, 889 aa, Homo sapiens
MELVKAALAEALRLLRLQVPPSSLQGSGTPAPPGDSSLAAPPGLPPTCTPSLVSRGTQTETEVELKSSPGPPGLSNGPPAPQGASEEPSGTQSEGGGSSSSGAGSPGPPGILRPLQPPQRADTPRRNSSSSSSPSERPRQKLSRKAISSANLLVRSGSTESRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDNSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYVPVRSCQGAEPHVRGPRQPRDQRPIHARRLAPRLAGRQGRQHLPVASAGRWGRGAGARHALSNPLPVPRLLPRRLIAAWRDRLARRRGPAPPCPSLAQSPTTRGRLFPGLTSRHSRSRIFLEGANGAPAHTV

SEQ ID NO: 3450 - protein, 729 aa, Homo sapiens [sequence omitted]

SEQ ID NO: 3451 - protein, 185 aa, Homo sapiens [sequence omitted]

SEQ ID NO: 3452 - protein, 411 aa, Homo sapiens
MPMWNKVSGVHLSPSSPEIVLDRDHSSSIGCLSSDAIISSPENTHAANSIVSQTIPKAQIQQSTHTHLDISLFPLGLTDEKSNGTIALVDDSEDPGANVSNIQLQQKISSLEIKLKVSEEEKQRIKQDVESLMEKHNVLEKGFLKEKEQEAISFQDRYKELQEKHKQELEDMRKAGHEALSIIVDEYKALLQSSVKQQVEAIEKQYISAIEKQAHKCEELLNAQHQRLLEMLDTEKELLKEKIKEALIQQSQEQKEILEKCLEEERQRNKEALVSAAKLEKEAMKDAVLKVVEEERKNLEKAHAEERELWKTEHAKDQEKVSQEIQKAIQEQRKISQETVKAAIIEEQKRSEKAVEEAVKRTRDELIEYIKEQKRLDQVIRQRSLSSLELFLSCAQKQLSALIATEPVDIE

SEQ ID NO: 3453 - protein, 791 aa, Homo sapiens
MSNRQEKYEAQNIVNSTEESDDAFDTVTIPVPSEEPQESDQTEEHESGIEQFSESHAIHVEEQSDQSFSSLEPDNEQLMEEVISPRQVSYTPQHHEKQYAMQRPNDDSLAFLDKIKSVKESLQESVEDSLATVKVVLIPVGQEIVIPFKVDTILKYLKDHFSHLLGIPHSVLQIRYSGKILKNNETLVQHGVKPQEIVQVEIFSTNPDLYPVRRIDGLTDVSQIITVTVQTGLDQYQQVPVEIVKSDFHKPSLGGFRHKVTGVEYHNAGTQTVPKRIPERLSIFCRDTQTVFQKKNLQQTTNTTSTQMTNIGVYVSNMTDKLVTPGKYFSAAEYHAQRLKAVTVIQTYYRQWHAKIFVENLRRQKSLRLEWETQQELRKIREKEEWIKLDYHRRHNPKTNEDFEFLYNALEFWRQEELTRINQSFTGAERKAALCELLEKETQIIASIGRHRYIAYMANQEAAIQAFLDKCSAPKIWRTPNGKTIEMDTQFTIRARELQNIYKCIMLKNISQDERLDVLLTLKHTVKEHECKLTQEILELIDREVDLMMRGVKHHNLEGLRKRIATLFFHYIKTPLFNPEVAKYLKVPQDPLKFYKKIYFCHSCQLYLPSTEFSVSSTSRRIYRCRNCINLQNEAQKRESFLKYKCLLQQLYYTEADYEDDSKIAFLMQLQDIQYLTENIWASQSVLSACDNLSDLVMVRWNKSLEWSPWNCILLTKDEAAAHLKLTSIEEGYERSFIHKIKHKHILAKNYFSQVPVLASFILDDGEIDEIRWKYHSDTTPKIIESQRPPH

SEQ ID NO: 3454 - protein, 388 aa, Homo sapiens
MLSQETLPLKIHGWKSTEDLMTFLDDDPELPLLATPPSIVSPITCLSEAEEVCNLSGADAVPTLSENSPSGQRDVSLDKRSDGIFTNTVTENLLETPLEKQSAAEGLKTLTILPACWSSKEEFISPDLRVSKSDSTFHNQASVETLCLSPSFKIFDRVKEIVINKAYQKPAQSSIQMDDKILKTTTRVSTASEGASSFSPLSMSSPDLASPEKSAHLLSPILAGPSFWTLSHQQLSSTSFKDEDKTAKLHHSFASRGPVSSDVEENDSLNLLGILPNNSDSAKKNISHISSSHWGEFSTQNVDQFIPLSCSGFQSTKDFPQEPEAKNSISVLLREVKRAIARLHEDLSTVIQELNVINNILMSMSLNSSQIGQSSQVPQSSEGSSDQI

SEQ ID NO: 3455 - protein, 259 aa, Homo sapiens
MRDRRGPLGTCLAQVQQAGGGDSDKLSCSLKKRMPEGPWPADAPSWMNKPVVDGNSQSEALSLEMRKDPSGAGLWLHSGGPVLPYVRESVRRNPASAATPSTAVGLFPAPTECFARVSCSGVEALGQRDWLGGGPRATDGHRGQCPKGEPRVSRLPRHQKLPEMGSFQDDPPSAFPKGLGSELEPACLHSILSATLHMYPEVLLSEETKRIFLDRLKPMFSKQTIEFKKMLKSTSDGLQITLGLLALQPFELANTLCHS

SEQ ID NO: 3456 - protein, 500 aa, Homo sapiens
MALSDSSELTCSTTFSSCTISSLQCGTEYLISVLASNDAGSSKSSSAMTLKTVACAPGRVTIQEDPPGHLSVAWSNVDLGDYYVVFVKSDDGLEVHCNTSLTQCNFLSECGFTYFISVFAYNKAGQSPLGDIFNYTTAPCCPSDINPVLVSSDRVEIVWSPVRGAELYETKAVDGYNMVECNDTTPACTLSALECDTKYNITVYSFNEVRGSNMSCTPQFITTAPCSPEIKNVSRDAFSMINVHWRSTNDDATYTVTAQGEKGLYQCSSTGESCTMRGLPCGSVFSVTAVAETQAGRSLPSYSVPLETVPCCPTGLTVTQITQSVINVSWTIGRVAQTHVAVLESHTGQSKCHTHQNHCLLGCITCGINYTVTLKAISATGLTADCSYQSYFSGACCPLGVKLYRLGPNGIRIYWQASRGSANYSTDLYGSKGIFTCTPSAGLSFCDVTEIPCGDVYTVMVSPVAKTGLKLTFCPKKIYSVTCSGSTLGMVIYRGKRNEE

SEQ ID NO: 3457 - protein, 144 aa, Homo sapiens
MSLKSLFCNSEAKDNKCYHTYSESSWSETKKIVIATKIHSFQTFSSCYSDCHGILGVLLHQLETSVAGGTFCLSIAHAWWARFAHSSWKAALGSCYQPGFHTCQGQARLGSVRGVWASEHGVQPQRTGRHTGCCSRVGSFRHCS

SEQ ID NO: 3458 - protein, 315 aa, Homo sapiens
MHQLLQALHQKLAALRQGPEGLVGADKPISYRTKPPASIHRELLGVCSDPYTLAQQLTHVELERLRHIGPEEFVQAFVNKDPLASTKPCFSDKTSNLEAYVKWFNRLCYLVATEICMPAKKKQRAQVIEFFIDVARECFNIGNFNSLMAIISGMNMSPVSRLKKTWAKVRTAKFFILEHQMDPTGNFCNYRTALRGAAHRSLTAHSSREKIVIPFFSLLIKDIYFLNEGCANRLPNGHVNFEKFLELAKQVGEFITWKQVECPFEQDASITHYLYTAPIFSEDGLYLASYESESPENQTEKERWKALRSSILGKT

SEQ ID NO: 3459 - protein, 243 aa, Homo sapiens
MELDGQKGQELERRLQSFQHHGPGGDLLGTLPAPPQHPTHGQCQMAPGAEPDMEQTIHSPQHLPEELRTVTEKIYYLKLHPDHPETVFHFWIRLVQILQKGLSITTKDPRILVTHCLVPKNCSSPSGDSKLVQKKLQASQPSESLIQLMTKGESEALSQIFADLHQQNQLRSSRKVETNKNSSGKDSSREDSIPCTCDLRWRASFTYGEWERENPSGLQPLSLLSTLAASTGPQLAPPIGNSI

SEQ ID NO: 3460 - protein, 563 aa, Homo sapiens
MSVLKKNRRKDSDTPQEPSEKAKEQQAEAELRKLRQQFRKMVESRKSFKFRNQQKIASQYKEIKTLKTEQDEITLLLSLMKSSRNMNRSEKNYMELRLLLQTKEDYEALIKSLKVLLAELDEKILQMEKKIANQKQIFAKMQEANNPRKLQKQIHILETRLNLVTVHFDKMLTTNAKLRKEIEDLRFEKAAYDNVYQQLQHCLLMEKKTMNLAIEQSSQAYEQRVEAMARMAAMKDRQKKDTSQYNLEIRELERLYAHESKLKSFLLVKLNDRNEFEEQAKREEALKAKKHVKKNRGESFESYEVAHLRLLKLAESGNLNQLIEDFLAKEEKNFARFTYVTELNNDMEMMHKRTQRIQDEIILLRSQQKLSHDDNHSVLRQLEDKLRKTTEEADMYESKYGEVSKTLDLLKNSVEKLFKKINCDATKILVQLGETGKVTDINLPQYFAIIEKKTNDLLLLETYRRILEVEGAEAEIPPPFINPFWGGSALLKPPEPIKVIPPVLGADPFSDRLDDVEQPLDHSSLRQLVLDNYILKENRSKEVRGDSLPEKVDDFRSRKKVTM

SEQ ID NO: 3461 - protein, 543 aa, Homo sapiens
MDSVVFEDVAVDFTLEEWALLDSAQRDLYRDVMLETFQNLASVDDETQFKASGSVSQQDIYGEKIPKESKIATFTRNVSWASVLGKIWDSLSIEDQTTNQGRNLRNHGLERLCESNDQCGEALSQIPHLNLYKKIPPGVKQYEYNTYGKVFMHRRTSLKSPITVHTGHKPYQCQECGQAYSCRSHLRMHVRTHNGERPYVCKLCGKTFPRTSSLNRHVRIHTAEKTYECKQCGKAFIDFSSLTSHLRSHTGEKPYKCKECGKAFSYSSTFRRHTITHTGEKPYKCKECAEAFSYSSTFRRHMISHTGEKPHKCKECGEAFSYSSAFRRHMITHTGEKPYECKQCGKTFIYLQSFRRHERIHTGEKPYECKQCGKTFIYPQSFRRHERTHGGEKPYECNQCGKAFSHPSSFRGHMRVHTGEKPYECKQCGKTFNWPISLRKHMRTHTREKLYKCKQCGKVFKWPSSLPIHMRLHTGEKPYQCKHCGKAFNCSSSLRRHVRIHTTEKQYKCNVGHPPANEFMCSASEKSHQERDLIKVVNMVLPL

SEQ ID NO: 3462 - protein, 192 aa, Homo sapiens
MLDFFDLLWIVGIADFVLKYITIALKCLIVALPKIILAVKSKGKFYLVIEELSQLFRSLVPIQLWYKYIMGDDSSNSYFLGGVLIVLYSLCKSFDICGRVGGVRKALKLLCTSQNYGVRATGQQCTEAGDICAICQAEFREPLILLCQHVFCEECLCLWLDRERTCPLCRSVAVDTLRCWKDGATSAHFQVY

SEQ ID NO: 3463 - protein, 235 aa, Homo sapiens
MPAAERGARGRASPLARRRRRRQTRYPPPFPVLPPPPAPLLLPRGVPSPPASPLCLLPPPGPAGRGHPREPRLECTANHIFRSRWRGKSGRKSPRLAAPHSFSAPGLGFPCRPPGIACVGPALSSGDCAGKSEISVGSCQIRPFFPSGGNGTAGCSGRAAVVAPRRPRPRPPTSRALTPAPPLTWRARWPPAGACRQHDTLLSSPAKGSFSPDAGGLPCECTEGSHGRRIKLKDR

SEQ ID NO: 3464 - protein, 604 aa, Homo sapiens
MNTSRFADHHDLLTETKRPIDTVISQQAFYSDESVSAMEKQYLRNSNLTPQQKIDELHHGFTGLDLEEQWMYPSRSDHSNCHNIQTNDTAKTTFQEYPLIKNCFTPQTGLSDIMKESGVDIYHYGRDRICTKGLEAPLQQKRAEMFLSQFNRYTENVDYCRYPEYVHPNKAKLNKCSNFSVQDSKKLANGTPETPTVEADTYTKLFQVKPANQKKMEETIPDQQNFTFPKTTPHLTEKQFAKEAVFTADFGLTSEYGLKPHTACPANDFANVTEKQQFAKPDPPHSEYFKSVNLLSNSATSSGGINLNRPTWMNVQTKNNTPIPYRNQGNLMKLNSHLSAASKGSNHSSDFPQLSSTNLTPNSNLFQKYCQENPSAFSSFDFSYSSAERIQSVNHIEGLTKPGEENLFKLVTDKKIKQPNGFCDNYSAQKYGIIENVNKHNFQAKPQSGHYDPEEGPKHLDGLSQNTYQDLLESQGHSNSHRTRGGDNSRVNRTQVSCFSNNYMMGDLRHNQCFQQLGSNGFPLRSTHPFGHSVVPLLDSYDLLSYDDLSHLYPYFNMMYGDNSFSGLMPTFGFQRPIKTRSGPASELHIRLEECCEQWRALEK

SEQ ID NO: 3465 - protein, 717 aa, Homo sapiens [sequence omitted]

SEQ ID NO: 3466 - protein, 245 aa, Homo sapiens
MRLAGGEAAAGRAADSGGLGHIPGADRSPAGAAPLRRQGASRLSSPRPGAVSLPTHRQDASPRPQSALSPAPGGAGEGDGGCGGAGRLAEWPGTVRELGLRARRGTVGPGWAPTCMPVPAGVTGSFAECSTAPSRSWRRWPGRTERRGCSAALARWPSGEPGGGRGRGPPPARLSPRRRCVLGALQVLLTLPLLFLGLSLLWTVLLDPGAVSAWLWSLTSETTLRRLRYTLSPLLELRANGLLPT

SEQ ID NO: 3467 - protein, 504 aa, Homo sapiens [sequence omitted]

SEQ ID NO: 3468 - protein, 229 aa, Homo sapiens
MEAARPFAREWRAQSLPLAVGGVLKLRLCELWLLLLGSSLNARFLPDEEDVDFINEYVNLHNELRGDVIPRGSNLRFMTWDVALSRTARAWGKKCLFTHNIYLQDVQMVHPKFYGIGENMWVGPENEFTASIAIRSWHAEKKMYNFENGSCSGDCSNYIQLVWDHSYKVGCAVTPCSKIGHIIHAAIFICNYAPGGTLTRRPYEPGIFCTRCGRRDKCTDFLCSNADRD

SEQ ID NO: 3469 - protein, 495 aa, Homo sapiens [sequence omitted]

SEQ ID NO: 3470 - protein, 475 aa, Homo sapiens
MAEGSVMFSDVSIDFSQEEWDCLDPVQRDLYRDVMLENYGNLVSMGLYTPKPQVISLLEQGKEPWMVGRELTRGLCSDLESMCETKLLSLKKEVYEIELCQREIMGLTKHGLEYSSFGDVLEYRSHLAKQLGYPNGHFSQEIFTPEYMPTFIQQTFLTLHQIINNEDRPYECKKCGKAFSQNSQFIQHQRIHIGEKSYECKECGKFFSCGSHVTRHLKIHTGEKPFECKECGKAFSCSSYLSQHQRIHTGKKPYECKECGKAFSYCSNLIDHQRIHTGEKPYECKVCGKAFTKSSQLFQHARIHTGEKPYECKECGKAFTQSSKLVQHQRIHTGEKPYECKECGKAFSSGSALTNHQRIHTGEKPYDCKECGKAFTQSSQLRQHQRIHAGEKPFECLECGKAFTQNSQLFQHQRIHTDEKPYECNECGKAFNKCSNLTRHLRIHTGEKPYNCKECGKAFSSGSDLIRHQGIHTNK

SEQ ID NO: 3471 - protein, 162 aa, Homo sapiens
MLEGVKYLCIPAADSPSQNLTRHFKESIKFIHECRLRGESCLVHCLAGVSRSVTLVIAYIMTVTDFGWEDALHTVRAGRSCANPNVGFQRQLQEFEKHEVHQYRQWLKEEYGESPLQDAEEAKNILGKYKEQGRTEPQPGARRWSSFPALAPLTYDNYTTET

SEQ ID NO: 3472 - protein, 172 aa, Homo sapiens [sequence omitted]

SEQ ID NO: 3473 - protein, 663 aa, Homo sapiens [sequence omitted]

SEQ ID NO: 3474 - protein, 732 aa, Homo sapiens
MTPPKSSQELLSVRQESVEPQPRGVPKKERARSPDLGPQEQMNPKEKLKPFQRSGLPFPKSGVVSRLEQGEPWIPDLLGSKEKELPSGSHIGDRRVHADLLPSKKDRRSWVEQDHWSFEDEKVAGVHWGYEETRTLLAILSQTEFYEALRNCHRNSQVYGAVAERLREYGFLRTLEQCRTKFKGLQKSYRKVKSGHPPETCPFFEEMEALMSAQVIALPSNGLEAAASHSGLVGSDAETEEPGQRGWQHEEGAEEAVAQESDSDDMDLEATPQDPNSAAPVVFRSPGGVHWGYEETKTYLAILSETQFYEALRNCHRNSQLYGAVAERLWEYGFLRTPEQCRTKFKSLQTSYRKVKNGQAPETCPFFEEMDALVSVRVAAPPNDGQEETASCPVQGTSEAEAQKQAEEADEATEEDSDDDEEDTEIPPGAVITRAPVLFQSPRGFEAGFENEDNSKRDISEEVQLHRTLLARSERKIPRYLHQGKGNESDCRSGRQWAKTSGEKRGKLTLPEKSLSEVLSQQRPCLGERPYKYLKYSKSFGPNSLLMHQVSHQVENPYKCADCGKSFSRSARLIRHRRIHTGEKPYKCLDCGKSFRDSSNFITHRRIHTGEKPYQCGECGKCFNQSSSLIIHQRTHTGEKPYQCEECGKSFNNSSHFSAHRRIHTGERPHVCPDCGKSFSKSSDLRAHHRTHTGEKPYGCHDCGKCFSKSSALNKHGEIHAREKLLTQSAPK

SEQ ID NO: 3475 - protein, 412 aa, Homo sapiens [sequence omitted]

SEQ ID NO: 3476 - protein, 109 aa, Homo sapiens
MVHSHPHHPRVWESRLSQGASPPLVWYRKSHRELVLSSPSDKRLPPPWCQRRPHWEPELPPTHSCNKAVPPPPCWGGVRGGQVESQDFHHSPVTMKPPPYGVSGGHKEQ

SEQ ID NO: 3477 - protein, 778 aa, Homo sapiens [sequence omitted]

SEQ ID NO: 3478 - protein, 164 aa, Homo sapiens [sequence omitted]

SEQ ID NO: 3479 - protein, 549 aa, Homo sapiens
MINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEEKEADAYTPLWFEKRLDPLTGEMACVYKGGYWEAKEKQDWHMCPNIF

SEQ ID NO: 3480 - protein, 180 aa, Homo sapiens
MPSSVPKTSIESLGSPSSLSSSQASEPLCPLKHPSHRPPASTLSPNPTSSTESLGYLSSLSSSQPPEPLRPLKHPSHKPHGRSPPRRRNPGWVSWSDSMQADSETDAIICPMCKAPERSCPHTWWVPSSPRVIRGVGRCSDPNLGLSWRQEAARAWCHCTSSQYPFEHPNLPTHLPKASF

SEQ ID NO: 3481 - protein, 492 aa, Homo sapiens
MMALRAKCQGYVIFVISLGSTRKDDMEELASYPLDQHLIQLGRIHKPDLNYIAKFLKPFLYSVRRGFNQYPPPMLEDACRLINLGGENIRNDGFQFVTELQEDFLGDNGFIGQELNSGRESPFVKTEDNGSDYLVYLPSQMFEPQKLMINYEKDQKSAEIASLTSGHENYGRKEEPDHTYEPGDVSLQEYYMDVAFLIDASQRVGSDEFKEVKAFITSVLDYFHIAPTPLTSTLGDRVAVLSYSPPGYMPNTEECPVYLEFDLVTYNSIHQMKHHLQDSQQLNGDVFIGHALQWTIDNVFVGTPNLRKNKVIFVISAGETNSLDKDVLRNVSLRAKCQGYSIFVFSFGPKHNDKELEELASHPLDHHLVQLGRTHKPDWNYIIRFVKPFVHLIRRAINKYPTEDMKATCVNMTPPNPENGGTENTVLLLPGIYEIKTENGDLFDEFDSQAQHLLVLGNNHSNGSETATDLMQKLYLLFSTEKLAMKDKEKAH

SEQ ID NO: 3482 - protein, 471 aa, Homo sapiens
MEFVTALVNLQEESSCPICLEYLKDPVTINCGHNFCRSCLSVSWKDLDDTFPCPVCRFCFPYKSFRRNPQLRNLTEIAKQLQIRRSKRKRQKENAMCEKHNQFLTLFCVKDLEILCTQCSFSTKHQKHYICPIKKAASYHREILEGSLEPLRNNIERVEKVIILQGSKSVELKKKVEYKREEINSEFEQIRLFLQNEQEMILRQIQDEEMNILAKLNENLVELSDYVSTLKHLLREVEGKSVQSNLELLTQAKSMHHKYQNLKCPELFSFRLTKYGFSLPPQYSGLDRIIKPFQVDVILDLNTAHPQLLVSEDRKAVRYERKKRNICYDPRRFYVCPAVLGSQRFSSGRHYWEVEVGNKPKWILGVCQDCLLRNWQDQPSVLGGFWAIGRYMKSGYVASGPKTTQLLPVVKPSKIGIFLDYELGDLSFYNMNDRSILYTFNDCFTEAVWPYFYTGTDSEPLKICSVSDSER

SEQ ID NO: 3483 - protein, 131 aa, Homo sapiens
MRKPRRAGWETLSRKAPGPSAGLRPSPATCDTCHFPILGDGNATLPFAPGKTSRVPSDSGVFSSDPRANWSSIRNFPSAKCVGIELHASLSTSAEWLLRGRGGALPWIVRCLAATDLLLPGKKGVESCPVG

SEQ ID NO: 3484 - protein, 376 aa, Homo sapiens
MLTFLQQLRVDWPAASERASSHTLRSHALEELTSANDGRTLSPGILGRLCLKELVEEQGRTAGYDPNLDNCLVTEDLLSVLAELQEALWHWPEDSHPGLAGASDTGTGGCLVVHVVSCEEEFQQQKLDLLWRKLVDKAPLRQKHLICGPVKVAGAPGTLMTAPEYYEFRHTQVCKASALKHGGDLAQDPAWTEIFGVLSVATIKFEMLSTAPQSQLFLALADSSISTKGTKSGTFVMYNCARLATLFESYKCSMEQGLYPTFPPVSSLDFSLLHDEGEWLLLFNSILPFPDLLSRTAVLDCTAPGLHIAVRTEMICKFLVQLSMDFSSYYNRVHILGEPRPHLFGQMFVRLQLLRAVREVLHTGLAMLGLPPLSHI

SEQ ID NO: 3485 - protein, 586 aa, Homo sapiens
MEVGGCTFIHPDVQKLLETLIAKRALMKMWQEKERKRADHPHMTSLGKEWDITTLNPFWNVSTQPQQLPRPQQVSDATTVGNHLQQKRSQLFWDLPSLNSESLATTVWVSRNPSSQNAHSVPLDKASTSLPGEPEVEASSQLSQAPPQPHHMAQPQHFTPAWPQSQPPPLAEIQTQAHLSPPVPSLGCSSPPQIRGCGASYPTSQERTQSVIPTGKEYLEWPLKKRPKWKRVLPSLLKKSQAVLSQPTAHLPQERPASWSPKSAPILPGVVTSPELPEHWWQGRNAIHQEQSCGPPSRLQASGDLLQPDGEFPGRPQSQAEDTQQALLPSQPSDFAGKGRKDVQKTGFRSSGRFSDKGCLGSKLGPDPSRDQGSGRTSVKALDEDKEAEGDLRRSWKYQSVSSTPRDPDKEHLENKLQIHLARKVGEIKEGWIPMPVRRSWLMAKCAVPKSDTHRKPGKLASWRGGKAHVNTSQELSFLHPCTQQILEVHLVRFCVRHSWGTDLQSLEPINVWSGEAQAPPFPQSTFTPWASWVSRVESVPKVPIFLGKRPQNGPGDNRTTSKSVPTVSGPLAATGVTATKNVAER

SEQ ID NO: 3486 - protein, 161 aa, Homo sapiens [sequence omitted]

SEQ ID NO: 3487 - protein, 124 aa, Homo sapiens
MGEHVVPPLQVSQCIEQHWGKVTVGWLPTEVCANITCVTTPRVQWNKRPYEGQAPMDFVPPGSLWVCGDTGWPYLPANWTGHCTWGWPYVPATGLPTLPSRHITGSHCVPAFSQCSRPSSGSIP

SEQ ID NO: 3488 - protein, 508 aa, Homo sapiens
MESEDTKKTQEMKTDLNLLLECLKYQMDNAFSQKEALVTIHSICQQNSNASVYFREIGGLMFVKNLAKSSEHSMVKEAALYTLGAIAEKNVYCQQTLCTSELFEDLTWFLSNDSNINLKRMSVYVILVLVSNNRTGQTLVRETGCITVLSRLFRTVISKHELDLSDKNVFQSYQLWSSVCSTLCVCVNNPQNDENQMFCCSLFPHANEWLKNCTTPEIIRPICSFIGLTLANNTYVQKYFVSVGGLDVLSQVLMQLESDSHETLSSAKLAVVVTKTVDACIADNPTFGIVLSKYHIVSKLLALLLHESLDSGEKFSIMLTLGHCTEDCAEKLSLSLGEYPFDENETQQLKDISVKENNLEEHWRKAKEILHRIEQLEREGNEEEIQRENYQDNISSMNISIQNTWKHLHADRIGRGSKAEDEDKSHSRQLQSYKSHGVMSKACTNDDQMKTPLKSANPVHACYRESEQNKTLYKAKSSCNQNLHEETTFEKNFVSQSRSIYIMFRYNK

SEQ ID NO: 3489 - protein, 140 aa, Homo sapiens
MPLLPFSHFYCLPKSCRSCPMLSLFSIFSAPGSRVLFSSDQTCLQHVLDGWLCSKCLTNPNSPHSHNLQFTEDETEAQRSQASCAGPGLGPTQPAPEPGSDPPQEPSLKFHLPLHLQSLPLSIPPTCSQTKSSSLFNKTI

SEQ ID NO: 3490 - protein, 351 aa, Homo sapiens
MLEVLRVLSTSSEALHHAVIFLFNGAEENVLQASHGFITQHPWASLIRAFINLEAAGVGGKELVFQTGPENPWLVQAYVSAAKHPFASVVAQEVFQSGIIPSDTDFRIYRDFGNIPGIDLAFIENGYIYHTKYDTADRILTDSIQRAGDNILAVLKHLATSDMLAAASKYRHGNMVFFDVLGLFVIAYPSRIGSIINYMVVMGVVLYLGKKFLQPKHKTGNYKKDFLCGLGITLISWFTSLVTVLIIAVFISLIGQSLSWYNHFYVSVCLYGTATVAKIILIHTLAKRFYYMNASAQYLGEVFFDISLFVHCCFLVTLTYQGLCSAFISAVWVAFPLLTKLCVHKDFKQHD

SEQ ID NO: 3491 - protein, 120 aa, Homo sapiens [sequence omitted]

SEQ ID NO: 3492 - protein, 649 aa, Homo sapiens
MQENLRFASSGDDIKIWDASSMTLVDKFNPHTSPHGISSICWSSNNNFLVTASSSGDKIVVSSCKCKPVPLLELAEGQKQTCVNLNSTSMYLVSGGLNNTVNIWDLKSKRVHRSLKDHKDQVTCVTYNWNDCYIASGSLSGEIILHSVTTNLSSTPFGHGSNQSVRHLKCSLFKKSLLGSVSDNGIVTLWDVNSQSPYHNFDSVHKAPASGICFSPVNELLFVTIGLDKRIILYDTSSKKLVKTLVADTPLTAVDFMPDGATLAIGSSRGKIYQYDLRMLKSPVKTISAHKTSVQCIAFQYSTVLTKSSLNKGCSNKPTTVNKRSVNVNAASGGVQNSGIVREAPATSIATVLPQPMTSAMGKGTVAVQEKAGLPRSINTDTLSKETDSGKNQDFSSFDDTGKSSLGDVFSPIRDDAVVNKGSDESIGKGDGFDFLPQLNSVFPPRKNPVTSSTSVLHSSPLNVFMGSPGKEENENRDLTAESKKIYMGKQESKDSFKQLAKLVTSGAESGNLNTSPSSNQTRNSEKFEKPENEIEAQLICEPPINGSSTPNPKIASSVTAGVASSLSEKIADSIGNNRQNAPLTSIQIRFIQNMIQETLDDFREACHRDIVNLQVEMIKQFHMQLNEMHSLLERYSVNEGLVAEIERP

SEQ ID NO: 3493 - protein, 543 aa, Homo sapiens
MAKGEGAESGSAAGLLPTSILQSTERPAQVKKEPKKKKQQLSVCNKLCYALGGAPYQVTGCALGFFLQIYLLDVAQKDEEVVFCFSSFQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSETDSTELASIL

SEQ ID NO: 3494 - protein, 178 aa, Homo sapiens
MPIKPVGWICGQVLKNFSGRIEGVQKAIMDLVDEFKDEFPTILRLSQSNQVRKGSLFEIISFPAKTALTSIIYASYAALIYLAVCVNAVLKKVKNIFQEEESIRQNREESENCRKAFSEPVLSEPMFAEGEIEAKPYRSLPEKPDISDYPKLLANKQSNNIQVLHSVFDQSAEMNEQI

SEQ ID NO: 3495 - protein, 550 aa, Homo sapiens
MAEEKGGKQVLEESAFEEMERDFQGVLHELSGDKSLEKFRIEYERLHAVMKKSYDNEKRLMAKCRELNAEIVVNSAKVATALKLSQDDQTTIASLKKEIEKAWKMVDSAYDKEQKAKETILALKEEIVNLTKLVEQGSGLSMDQHSNIRDLLRFKEEVTKERDQLLSEVVKLRESLAQTTEQQQETERSKEEAEHAISQFQQEIQQRQNEASREFRKKEKLEKELKQIQADMDSRQTEIKALQQYVQKSKEELQKLEQQLKEQKILNERAAKELEQFQMRNAKLQQENEQHSLVCEQLSQENQQKALELKAKEEEVHQMRLDIGKLNKIREQIHKKLHHTEDQKAEVEQHKETLKNQIVGLEREVEASKKQAELDRKAMDELLRERDILNKNMLKAVNATQKQTDLVKLHEQAKRNLEGEIQNYKDEAQKQRKIIFHLEKERDRYINQASDLTQKVLMNMEDIKVRETQIFDYRKKIAESEIKLKQQQNLYEAVRSDRNLYSKNLVEAQDEITDMKRKLKIMIHQVDELKEDISAKESALVKLHLEQQRI

SEQ ID NO: 3496 - protein, 345 aa, Homo sapiens [sequence omitted]

SEQ ID NO: 3497 - protein, 124 aa, Homo sapiens
MACHTLLVCALLVSLLPSCLPFLCWRLIPFMLSPPRCLHCLLGQSYLVPSLFKKQALPIMVEFLSIKGHTFRPPGTSREQCCAQETEFSCVGPAAAIRFQTPTEITKTALCNLEAYIIILSGIK

SEQ ID NO: 3498 - protein, 325 aa, Homo sapiens
MRSFYEKNPSCSRPWPPKPKNAITIALSSCALFNMVDGRKIYEQEGLEKYMEYQLTNENVILTPGPAFRFVKALQYVNARLRDLYPDEQDLFDIVLMTNNHAQVGVRLINSVNHYGLLIDRFCLTGGKDPIGYLKAYLTNLYIAADSEKVQEAIQEGIASATMFDGAKDMAYCDTQLRVAFDGDAVLFSDESEHFTKEHGLDKFFQYDTLCESKPLAQGPLKGFLEDLGRLQKKFYAKNERLLCPIRTYLVTARSAASSGARVLKTLRRWGLEIDEALFLAGAPKSPILVKIRPHIFFDDHMFHIEGAQRLGSIAAYGFNKKFSS

SEQ ID NO: 3499 - protein, 450 aa, Homo sapiens
MGEPRAGAALDDGSGWTGSEEGSEEGTGGSEGAGGDGGPDAEGVWSPDIEQSFQEALAIYPPCGRRKIILSDEGKMYGRNELIARYIKLRTGKTRTRKQVSSHIQVLARRKSREIQSKLKDQVSKDKAFQTMATMSSAQLISAPSLQAKLGPTGPQVVQASELFQFWSGGSGPPWNVPDVKPFSQTPFTLSLTPPSTDLPGYEPPQALSPLPPPTPSPPAWQARGLGTARLQLVEFSAFVEPPDAVDSYQRHLFVHISQHCPSPGAPPLESVDVRQIYDKFPEKKGGLRELYDRGPPHAFFLVKFWADLNWGPSGEEAGAGGSISSGGFYGVSSQYESLEHMTLTCSSKVCSFGKQVVEKVETERAQLEDGRFVYRLLRSPMCEYLVNFLHKLRQLPERYMMNSVLENFTILQVVTNRDTQELLLCTAYVFEVSTSERGAQHHIYRLVRD

SEQ ID NO: 3500 - protein, 548 aa, Homo sapiens [sequence omitted]

SEQ ID NO: 3501 - protein, 704 aa, Homo sapiens [sequence omitted]

SEQ ID NO: 3502 - protein, 367 aa, Homo sapiens
MLLLRCQLKQAPPQKVSFRFCVVMGKQQSKLKHSTYKYGRPDEIIEERIQTKAFQEYSPAHMDTVSVVAALNSDLCVSGGKDKTVVAYNWKTGNVVKRFKGHEHEITKVACIPKSSQFFSASRDRMVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 3503 - protein, 137 aa, Homo sapiens
MASPGLHPRFTLEFICMWVPTHLQCKAEPISLPDLADCRISFMTKNPTMRLGSLTQGGEHAILRHPFFKEIDWAQLNHRQIEPPFRPRIKSREDVSNFDPDFIKEEPVLTPIDEGHLPMINQDEFRNFSYVSPELQP

SEQ ID NO: 3504 - protein, 893 aa, Homo sapiens [sequence omitted]

SEQ ID NO: 3505 - protein, 136 aa, Homo sapiens
MNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 3506 - protein, 164 aa, Homo sapiens
MSGSPQASYPQTHSFTLKHQEIRTFWNLNMRGLGGEGGTEEESSLGQAGGKLKTAAWPSWVAEVGAAGALADPGGQKSGSFLPSQDSHKDFRGSWQLLHFQLPDPSHFPLPTNSNLGPSRGKQLQPSLTPLQMETCAPGCEHFKGCHTGHTLRCLDSFDERAKP

SEQ ID NO: 3507 - protein, 184 aa, Homo sapiens
MEQIRRIMRPTDVPDTGLLCDLLWSDPDKDVQGWGENDRGVSFTFGADVVSKFLNRHDLDLICRAHQVVEDGYEFFAKRQLVTLFSAPNYCGEFDNAGGMMSVDETLMCSFQILKPSEKKAKYQYGGLNSGRPVTPPRTANPPKKSPSFRREISEGQEGESVPHSLNTKEGILGNQNEAQSDVL

SEQ ID NO: 3508 - protein, 468 aa, Homo sapiens [sequence omitted]

SEQ ID NO: 3509 - protein, 514 aa, Homo sapiens
MADSGLDKKSTKCPDCSSASQKDVLCVCSSKTRVPPVLVVEMSQTSSIGSAESLISLERKKEKNINRDITSRKDLPSRTSNVERKASQQQWGRGNFTEGKVPHIRIENGAAIEEIYTFGRILGKGSFGIVIEATDKETETKWAIKKVNKEKAGSSAVKLLEREVNILKSVKHEHIIHLEQVFETPKKMYLVMELCEDGELKEILDRKGHFSENETRWIIQSLASAIAYLHNNDIVHRDLKLENIMVKSSLIDDNNEINLNIKVTDFGLAVKKQSRSEAMLQATCGTPIYMAPEVISAHDYSQQCDIWSIGVVMYMLLRGEPPFLASSEEKLFELIRKGELHFENAVWNSISDCAKSVLKQLMKVDPAHRITAKELLDNQWLTGNKLSSVRPTNVLEMMKEWKNNPESVEENTTEEKNKPSTEEKLKSYQPWGNVPDANYTSDEEEEKQSTAYEKQFPATSKDNFDMCSSSFTSSKLLPAEIKGEMEKTPVTPSQGTATKYPAKSGALSRTKKKL

SEQ ID NO: 3510 - protein, 222 aa, Homo sapiens
MSALVFFPPSSPLPIAFFPPSSPLPIAFFPPSSPLPIVFFPSLFSIFLPPPYPHLLLAAASSCRAFLSPHHLLFLFPTVLSPRPLLLSLSSPRAFPTTVLSPVFFPSHRFLPMSSHRLAAASVSRNLLPTFFSPPPIVFFPQPLILRHLLPLPTFSQQRLPAAFFSPRTLFSPLPLPTVFAPDRRLAHPLLALSNCLSPRSAPRVRPAVSLRLVCLCAQAAP

SEQ ID NO: 3511 - protein, 137 aa, Homo sapiens
MNGMPGENSEQAPRRCPSPCTTFFSPDVNSRSARVLFLLVVPGHLVFLYTISCMQGGHTTLTLIFIIFYMTAALLQVLILLYIADWMVHWMWGRGLDPDNFSIPYLTALGDLLGTGLLALSFHVLWLIGDRDTDVGD

SEQ ID NO: 3512 - protein, 623 aa, Homo sapiens [sequence omitted]

SEQ ID NO: 3513 - protein, 512 aa, Homo sapiens
MSSPLASLSKTRKVPLPSEPMNPGRRGIRIYGDEDEVDMLSDGCGSEEKISVPSCYGGIGAPVSRQVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVSDLRNQVYLEDGLDPFPGEGRVVGRQRMHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGSSPCPGPSPSPQ

SEQ ID NO: 3514 - protein, 419 aa, Homo sapiens [sequence omitted]

SEQ ID NO: 3515 - protein, 122 aa, Homo sapiens [sequence omitted]

SEQ ID NO: 3516 - protein, 503 aa, Homo sapiens
MNHLKFVRILKTTEVPGFDKLVLIIPWVVMQELDRMKEGKLLKRAQHKAIPAVHFINDSLKNQDRKLWGQSIQLASQKHYGLSDENNDDRVLKCCLQHQELFPCSFVILCTDDRNLRNKGLISGVKSLSKEELSAELLHLSLNTDVCHQPCIPKQQLKAETTPLKESYKEESTNSGLSILLESIVSDLEKSLGTGLSSILETEMKIAFGNLWMEILYLKPPWTLLHLLQCFKKHWLAVFGLVMEKNLLLTIESLYKNLRKANKAVDFTTVKFLLQDSRSLLHAFSTRSNYDGILPQTFAQVNNLLQTFAEVKTKLKPNSSENTVTKKQEGTSLKNSHNQEITVFSSSHLPQPSRHQEIWSILESVWITIYQNSTDVFQRLGSNSALTTSNIASFEEAFICLQKLMAAVRDILEGIQRILAPNSNYQDVETLYNFLIKYEVNKNVKFTAQEIYDCVSQTEYREKLTIGCRQLVEMEYTMQQCNASVYMEAKNRGWCEDMLNYRI

SEQ ID NO: 3517 - protein, 263 aa, Homo sapiens [sequence omitted]

SEQ ID NO: 3518 - protein, 201 aa, Homo sapiens [sequence omitted]

SEQ ID NO: 3519 - protein, 505 aa, Homo sapiens [sequence omitted]

SEQ ID NO: 3520 - protein, 421 aa, Homo sapiens [sequence omitted]

SEQ ID NO: 3521 - protein, 404 aa, Homo sapiens
MPLEDLLAFYGYEPTIPAVANSSANSSPSELADELPDMTLDKEEIAKDLLSGDDEETQSSADDLTPSVTSHETSDFFPRPLRSNTACDGDKESEVEDVETDSGNSPEDLRKEIMIGLQYQAEIPPYLGEYDGNEKVYENEDQLLWCPDVVLESKVKEYLVETSLRTGSEKIMDRISAGTHTRDNEQALYELLKCNHNIKEAIERYCCNGKASQEGMTAWTEEECRSFEHALMLFGKDFHLIQKNKVRTRTVAECVAFYYMWKKSERYDYFAQQTRFGKKRYNHHPGVTDYMDRLVDETEALGGTVNASALTSNRPEPIPDQQLNILNSFTASDLTALTNSVATVCDPTDVNCLDDSFPPLGNTPRGQVNHVPVVTEELLTLPSNGESDCFNLFETGFYHSELTL

SEQ ID NO: 3522 - protein, 146 aa, Homo sapiens
MRVGENWGCQSRLSAFSPPLQSAAPGAPAAAPAQRPHDTDRLKAPRLSACPRERVPTPRQVSEGWASPHADLRPHPTRVTINSSYLPRCFCTDSCPAPEGTVAVLWREQRAGWSRAGPAWVRRIWRARPCRHRVMRPKGPFHLQLR

SEQ ID NO: 3523 - protein, 110 aa, Homo sapiens
MYSTKVNTFERSDRRHSHSAELCPALAQHGGTLPPNPKTPKTATNPVLFPQMKLEVRMERDLNTIQPNLVISQAWKPRPQKRIDLKSRSCIPLEEALTLESDNMTLVQCP

SEQ ID NO: 3524 - protein, 330 aa, Homo sapiens
MDISKKNRVRQGSRGRGKTISKNSESRGQQRRHMVTNTKKETRFQWFFQRAEMPDGQYDPETGTGLLCIEELSKKDKGIYRAMVSDDRGEDDTILDLTGDALDAIFTELGRIGALSATPLKIQGTEEGIRIFSKVKYYNVEYMKTTWFHKDKRLESGDRIRTGTTLDEIWLHILDPKDSDKGKYTLEIAAGKEVRQLSTDLSGQAFEDAMAEHQRLKTLAIIEKNRAKVVRGLPDVATIMEDRTLCLTCIVSGDPTPEISWLKNDQPVTFLDRYRMEVRGTEVTITIEKVNSEDSGRYGVFVKNKYVSETGQVTISVFKHGDEPKELKSM

SEQ ID NO: 3525 - protein, 109 aa, Homo sapiens
MELEIKCLIKVLELDLEGSGEPWKMLDKGVTVSYVFEMTVEARLEGVNKSQETREGACGAGLEMVREGSCLDERSSGTVSGYTQVSSELVCSESCLQDENGKELSDEDI

SEQ ID NO: 3526 - protein, 549 aa, Homo sapiens [sequence omitted]

SEQ ID NO: 3527 - protein, 797 aa, Homo sapiens [sequence omitted]

SEQ ID NO: 3528 - protein, 464 aa, Homo sapiens
MSKLWFKQDDKFFLPKACLNFEFFSRYIYADPLHCNMTYLFIRLLKDDLKEYTYAARLSGLSYGIASGMNAILLSVKGYNDKQPILLKKIIEKMATFEIDEKRFEIIKEAYMRSLNNFRAEQPHQHAMYYLRLLMTEVAWTKDELKEALDDVTLPRLKAFIPQLLSRLHIEALLHGNITKQAALGIMQMVEDTLIEHAHTKPLLPSQLVRYREVQLPDRGWFVYQQRNEVHNNCGIEIYYQTDMQSTSENMFLELFCQIISEPCFNTLRTKEQLGYIVFSGPRRANGIQGLRFIIQSEKPPHYLESRVEAFLITMEKSIEDMTEEAFQKHIQALAIRRLDKPKKLSAECAKYWGEIISQQYNFDRDNTEVAYLKTLTKEDIIKFYKEMLAVDAPRRHKVSVHVLAREMDSCPVVGEFPCQNDINLSQAPALPQPEVIQNMTEFKRGLPLFPLVKPHINFMAAKL

SEQ ID NO: 3529 - protein, 351 aa, Homo sapiens [sequence omitted]

SEQ ID NO: 3530 - protein, 169 aa, Homo sapiens
MYHQSEALALASSQSHLLGRDSPSAVFEQDLENKEMSKEWFLFNDSRVTFTSFQSVQKITSRFPKDTAYVLLYKKQHSTNGLSGNNPTSGLWINGDPPLQKELMDAITKDNKLYLQEQELNARARALQAASASCSFRPNGFDDNDPPGSCGPTGGGGGGGFNTVGRLVF

SEQ ID NO: 3531 - protein, 145 aa, Homo sapiens [sequence omitted]

SEQ ID NO: 3532 - protein, 376 aa, Homo sapiens; identical to SEQ ID NO: 3484

SEQ ID NO: 3533 - protein, 180 aa, Homo sapiens
MEPGGSENAAALWISEGGRGPGRGPGPEWTSRSLLPQSGPALQPTPYSQRKGPRETHPDALKGGGGWGWGNTQSLSGECRKGVGAGEEKDGAAVSLSTPHLLAASAGLQPAPSPLGTAGPTTLSQAPSGSGTVLEWPVADTEPPASCICCPGCQCQFCRSHWGPQRGQGTLQSCTLKPAR

SEQ ID NO: 3534 - protein, 800 aa, Homo sapiens [sequence omitted]

SEQ ID NO: 3535 - protein, 558 aa, Homo sapiens [sequence omitted]

SEQ ID NO: 3536 - protein, 421 aa, Homo sapiens
MVSSLQKDILAKDEQVQQLKEEVSHLKSQNKDKDHQLEALGSRCSVLKEELKQEDAHRELREAQEKELKLCKTQIQDMEKEMKKLRAELRKSCTEQSVISRTLREKSKVEEKLQEDSRRKLLQLQEMGNRESVIKINLERAVGQLEHFRSQVIKATYGRAKPFRDKPVTDQQLIEKITQVTEDNINFQQKKWTLQKETQLSNSKQEETTENIEKLRTSLDSCQACMKISCCSHDLKKEVDLLQHLQVSPPVSGLQKVVLDVLRHALSWLEEVEQLLRDLGILPSSPNKDQVQQFSGNSAVFTAGKAAGASGREGEAERGEARARGEAQSQNQATDGREGGKALEEYITQERNRAKETLEEERKRMQELESLLAQQKKALAKSITQEKNRVKEALEEEQTRVQELEERLARQKEVLESSIAH

SEQ ID NO: 3537 - protein, 141 aa, Homo sapiens [sequence omitted]

SEQ ID NO: 3538 - protein, 157 aa, Homo sapiens [sequence omitted]

SEQ ID NO: 3539 - protein, 120 aa, Homo sapiens
MCHLYEGPVVGGWYKVLDRFIPGTTKVDALKKMLLDQGGFAPCFLGCFLPLVGALNGLSAQDNWAKLQRDYPDALITNYYLWPAVQLANFYLVPLHYRLAVVQCVAVIWNSYLSWKAHRL

SEQ ID NO: 3540 - protein, 581 aa, Homo sapiens
MDIIKGNLDGISKPASNSRIRPGSRSSNASLEVLSTEPGSFKVDTASNLNSGKEDHSESSNTENRRTSNDDKQESCSEKIKLAEEGSDEDLDLVQHQIISECSDEPKLKELDSQLQDAIQKMKKLDKILAKKQRREKEIKKQGLEMRIKLWEEIKSAKYSEAWQSKEEMENTKKFLSLTAVSEETVGPSHEEEDTFSSVFHTQIPPEEYEMQMQKLNKDFTCDVERNESLIKSGKKPFSNTEKIELRGKHNQDFIKRNIELAKESRNPVVMVDREKKRLVELLKDLDEKDSGLSSSEGDQSGWVVPVKGYELAVTQHQQLAEIDIKLQELSAASPTISSFSPRLENRNNQKPDRDGERNMEVTPGEKILRNTKEQRDLHNRLREIDEKLKMMKENVLESTSCLSEEQLKCLLDECILKQKSIIKLSSERKKEDIEDVTPVFPQLSRSIISKLLNESETKVQKTEVEDADMLESEECEASKGYYLTKALTGHNMSEALVTEAENMKCLQFSKDVIISDTKDYFMSKTLGIGRLKRPSFLDDPLYGISVSLSSEDQHLKLSSPENTIADEQETKDAAEECKEP

SEQ ID NO: 3541 - protein, 258 aa, Homo sapiens
MANQTATDITTLCPSSPDSPSSSCSMACSLPSGAGNNSEPPSPTMVLYQGYLNLLLWDLENVEFPETLLMDRIRLQELAFQLHQLTVLASVLLVARSFSGEVLFRSPEFVDRLKCTTKALTEEFISRPEETMLSVSEQVSQEVHQGLKDMGLTTLSSENTASLLGQLQNITKKENCIRSIVDQWIRFFLKCCLLHGMQESLLHFPGGLILIEKELAELGWKFLNLMHHNQQVFGPYYAEILKHIIHPAQAQETDVEPN

SEQ ID NO: 3542 - protein, 143 aa, Homo sapiens
MPSGPLPRTSVVPRPTTAPQETRNGTADAASKEGRKSSLPSVAPTGSASAAEDGAYTVRPSSGPHGSQPFTLAVLLRGRVFNTPIRRLDGGRHYALGREGRNREELFSSVAAMVQHFMWHPLPLVDRHSGSRELTCLLFPTKP

SEQ ID NO: 3543 - protein, 882 aa, Homo sapiens [sequence omitted]

SEQ ID NO: 3544 - protein, 133 aa, Homo sapiens [sequence omitted]

SEQ ID NO: 3545 - protein, 313 aa, Homo sapiens
MFLGELPEPLLTHKHFNAHLKIADLMQFDDKGNKTNIPDKDRQIEALQLLFLILPPPNRNLLKLLLDLLYQTAKKQDKNKMSAYNLALMFAPHVLWPKNVTANDLQENITKLNSGMAFMIKHSQKLFKAPAYIRECARLHYLGSRTQASKDDLDLIASCHTKSFQLAKSQKRNRVDSCPHQEETQHHTEEALRELFQHVHDMPESAKKKQLIRQFNKQSLTQTPGREPSTSQVQKRARSRSFSGLIKRKVLGNQMMSEKKKKNPTPESVAIGELKGTSKENRNLLFSGSPAVTMTPTRLKWSEGKKEGKKGFL

SEQ ID NO: 3546 - protein, 523 aa, Homo sapiens [sequence omitted]

SEQ ID NO: 3547 - protein, 148 aa, Homo sapiens [sequence omitted]

SEQ ID NO: 3548 - protein, 142 aa, Homo sapiens
MTKPQAKSGGSGMACQPQACQDGVRVSLPRSRAPVISRTGLLACLWAALSPEGRSHVEQNPAASEVALGCGVFLCQCCMTVCFCFCVCVCVCVCVSPILSSLSVSYSFPLSVGLFVSLCVCLFGRMCLVRQRSYFCMSSGLC

SEQ ID NO: 3549 - protein, 169 aa, Homo sapiens
MGSCGWALTQSDWCPFKKRKRHQRCAHSETRHMRTQRQGGYLQARERGLGEANPAYALILDFQPPELQNLSEMGINHELGYSSIIPMMKRAFSACGTLGLIMSGIFDNPGPIKNTLKKAFTMLWSFTVYTRLESLRVALSNEEMVPFIFHLKTQTANMLSGPISTPMLL

SEQ ID NO: 3550 - protein, 388 aa, Homo sapiens
MLEGSWINRKEDKLGVYSLVHFSPKMLGSVATTLPLSSSNSSGMPLGYYLSSPQISRVTISTTGQLTSKATVGSCSRVENSLDASPFSVPKKQDESPMIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPNIVMQANSTVTVWAAASEAKHQPPSDFLWKEQDKFRASPDCITILCKPNGQAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRSRSTRPNRASGSKKKKTSESQKQ

SEQ ID NO: 3551 - protein, 450 aa, Homo sapiens
MVTNQEELKISNLAFSLLLDEELSSREKFLNNYLTRKQHEKSQTSEAVRKSREDLDVCKEHYDNLLAEDKVMDRSFKKEFSEIPGHQVDILYKLFKRRPRISKQKTHSETTSVVPFGELPGSGKLNKDAFAQLMKAMDELDNISNMPEGLDPLVWNHFCMTRRAKVENEQKVKQKAADLLEMATFLQKRVEEEEKVQQEIERVFHELILLQEEKVRFQLNLTIQILLKQGQVELENFQLVLEYSDAILINKNIIEDLNSVIRTQGQKKVASMMESKDVHKRILQIEWEHKKMEMEREDLNQKAWDIQMLFFSRDRQKYLNEPNYEALISIQIGIMEQTIAVLDKMHKKNVENCKKLLKKLGKFSNQKDIANYALSCNLREELVAVSERKDICNAMGSKLTCEKIVKERYENMMQQQKLTNISKQQAEQISILQTEVERLRMKTFPALVQM

SEQ ID NO: 3552 - protein, 275 aa, Homo sapiens
MSQKRQTKFQNGKSKTSENSSAKREKGMVVNSKEISDAVGQSKFVLENLRHYTVHPNLAQYYKPLKATALQKFLAQNRKNTSFMLKVTQYDQDKTLLIMTNNPPPCSITQQDKESASKYFSKELLLKVMESHHQHKPTENLWLPRMPQKKKLRSKLKPIFPLILSDDPTSKREQWFRFSTDNDFKSEGKYSKVYALRTQKKMYPQLTFAPVHERDMRKDASKKSASERPISKVIREPLTLASLLEDMPTRTAPGESAFRNGRAPQWIIKKATVIG

SEQ ID NO: 3553 - protein, 168 aa, Homo sapiens
MDATIAPHRIPPEMPQYGEENHIFELMQVTGHPCPSRRWRRLGSLHCDVGCAAGTRSWGRVARPRSSPTRDVRFVCRRDPEGALELGTLLVLPGFASGGPRGRKGATRAGIWSWLCRQRALWSGTSPFLFSVSPPVKCQVARGGLPGALPALTITICRICGEPLGPGF

SEQ ID NO: 3554 - protein, 230 aa, Homo sapiens
MMPSPSDSSRSLTSRPSTRGLTHLRLHRPWLQALLALGLVQVLLGILVVTFSMVASSVTTTESIKRSCPSWAGFSLAFSGVVGIVSWKRPFTLVISFFSLLSVLCVMLSMAGSVLSCKNAQLARDFQQCSLEGKVCVCCPSVPLLRPCPESGQELKVAPNSTCDEARGALKNLLFSVCGLTICAAIICTLSAIVCCIQIFSLDLVHTVRREQGPGHAGMVGAGVCVLRLA

SEQ ID NO: 3555 - protein, 396 aa, Homo sapiens
MLITVYCVRRDLSEVTFSLQVSPDFELRNFKVLCEAESRVPVEEIQIIHMERLLIEDHCSLGSYGLKDGDIVVLLQKDNVGPRAPGRAPNQPRVDFSGIAVPGTSSSRPQHPGQQQQRTPAAQRSQGLASGEKVAGLQGLGSPALIRSMLLSNPHDLSLLKERNPPLAEALLSGSLETFSQVLMEQQREKALREQERLRLYTADPLDREAQAKIEEEIRQQNIEENMNIAIEEAPESFGQVTMLYINCKVNGHPLKAFVDSGAQMTIMSQACAERCNIMRLVDRRWAGVAKGVGTQRIIGRVHLAQIQIEGDFLQCSFSILEDQPMDMLLGLDMLRRHQCSIDLKKNVLVIGTTGTQTYFLPEGELPLCSRMVSGQDESSDKEITHSVMDSGRKEH

SEQ ID NO: 3556 - protein, 355 aa, Homo sapiens [sequence omitted]

SEQ ID NO: 3557 - protein, 132 aa, Homo sapiens
MPPGGKYEVQQCNRPVLLQGNPVEMTAMVGDFCLNYESDLVLQGQRRLGEFGFSRPNRHSVLGLEVSAVRCCHRQSHLNSSGQPVASDTHYALEGKQLSAWEQLRMVNSLGKECSEAKTLNSRNRSAAPHFR

SEQ ID NO: 3558 - protein, 263 aa, Homo sapiens
MGHPHQESSLFFTASGNLPLLLSLLSLMQLRNVSEQELDSVAMKLLHQVSKLCGKCSPTDVDILQPSFNFLYWSLHQTTPSSQKRAAAVLLSSTGLMELLEKMLALTLAKADSPRTALLCSAWLLTASFSAQQHKGSLQVHQTLSVEMDQVLKALSFPKKKAALLSAAILCFLRTALRQSFSSALVALVPSGAQPLPATKDTVLAPLRMSQVRSLVIGLQNLLVQKDPLLSQACVGCLEALLDYLDARSPDIGRNSPHYLMFP

SEQ ID NO: 3559 - protein, 811 aa, Homo sapiens [sequence omitted]

SEQ ID NO: 3560 - protein, 394 aa, Homo sapiens [sequence omitted]

SEQ ID NO: 3561 - protein, 130 aa, Homo sapiens
MERQMTEHSLRIQGPLQHCSRSASPQTSRGTQAAPLPAPPRAQQRAELRVILQLFSEHKSGTAGMVQTTPRRRPLDKMTPKRKAREPHGTQRKGAGKARQCRTQAAPGLGGGQAGVVTTSGSSRKYRTFS

SEQ ID NO: 3562 - protein, 107 aa, Homo sapiens
MAEKEAVNKMSLHNLGTVFGPTLLRPSEKESKLPANPSQPITMTDSWSLEVMSQIQIPNKMLECNPWTIRVLAAFDLPLSAWLRCSQEWVLKSLENRIRGGLGRGQA

SEQ ID NO: 3563 - protein, 464 aa, Homo sapiens
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGIINFIHFREACRETYMEFLWQYKSSADKMQQLNAAHQEALMKLERLDSVPVEEQEEFKQLSDGIQELQQSLNQDFHQKTIVLQEGNSQKKSNISEKTKRLNELKLSVVSLKEIQESLKTKIVDSPEKLKNYKEKMKDTVQKLKNARQEVVEKYEIYGDSVDCLPSCQLEVQLYQKKIQDLSDNREKLASILKESLNLEDQIESDESELKKLKTEENSFKRLMIVKKEKLATAQFKINKKHEDVKQYKRTVIEDCNKVQEKRGAVYERVTTINQEIQKIKLGIQQLKDAAEREKLKSQEIFLNLKTALEKYHDGIEKAAEDSYAKIDEKTAELKRKMFKMST

SEQ ID NO: 3564 - protein, 443 aa, Homo sapiens
MQPSEMVMNPKQVFLSVLIFGVAGLLLFMYLQVWIEEQHTGRVEKRREQKVTSGWGPVKYLRPVPRIMSTEKIQEHITNQNPKFHMPEDVREKKENLLLNSERSTRLLTKTSHSQGGDQALSKSTGSPTEKLIEKRQGAKTVFNKFSNMNWPVDIHPLNKSLVKDNKWKKTEETQEKRRSFLQEFCKKYGGVSHHQSHLFHTVSRIYVEDKHKILYCEVPKAGCSNWKRILMVLNGLASSAYNISHNAVHYGKHLKKLDSFDLKGIYTRLNTYTKAVFVRDPMERLVSAFRDKFEHPNSYYHPVFGKAIIKKYRPNACEEALINGSGVKFKEFIHYLLDSHRPVGMDIHWEKVSKLCYPCLINYDFVGKFETLEEDANYFLQMIGAPKELKFPNFKDRHSSDERTNAQVVRQYLKDLTRTERQLIYDFYYLDYLMFNYTTPFL

SEQ ID NO: 3565 - protein, 231 aa, Homo sapiens
MKRRRRRRPVAPATAARGGDFRAEDGAGLEAREEKVVYSRSQLSLADSTKALGDAFKLFMPRSTEFMSSDAELWSFLCSLKHQFSPHILRSKDVYGYSSCRALVPDPPGPPTARGQARRPVPRAAARRRRRGARAAAARRRKPRPPPPPPPPPEESCPAKPVAPGPCFGGRTLEEIWRAATPTLTTFPTIRVGSDVWGERSLAAARRRARQVLRVNLEPMVRLRRFPVPRA

SEQ ID NO: 3566 - protein, 137 aa, Homo sapiens
MLGVEDLVGAGRWGRGPENLPDSGGRLAEQALQGPSHPFSCLPPPEQILGAWRALKEELLSRAPSQFTLCTEVLQSSNLSPTPAVSPFVQSSVEMEKFLVPLSMFLSGERTWKLLLQVDFLNQGGEYYRNWRKRRRT

SEQ ID NO: 3567 - protein, 118 aa, Homo sapiens [sequence omitted]

SEQ ID NO: 3568 - protein, 137 aa, Homo sapiens
MTEMSFLSSEVLVGDLMSPFDQSGLGAEESLGLLDNYLEVAKHFKPHGFSRDKAKAGFSEWLAVDGLGSPSNNSKEDAFSGTDWMLEKMDLKEFVFDALLGIDDLETMPDELLTTLDDTCDLFAPLVRETNKETPRR

SEQ ID NO: 3569 - protein, 164 aa, Homo sapiens [sequence omitted]

SEQ ID NO: 3570 - protein, 130 aa, Homo sapiens
MGMRFQLLRERRISSRGPGFQAPKADPPRRKRLTAGLMTQVETQKEAHQRQAAMRQTALWRTGHIRPKTHTHTGIHTQTHRERERNTQRLRDRERRETGRHTHRHTHTHSHTHTHTHTQRHTHSVIQQRH

SEQ ID NO: 3571 - protein, 462 aa, Homo sapiens
MLCDEEAQKRKAKESGMALPQGRLTFMDVAIEFSQEEWKSLDPGQRALYRDVMLENYRNLVFLGICLPDLSIISMLKQRREPLILQSQVKIVKNTDGRECVRSVNTGRSCVLGSNAENKPIKNQLGLTLESHLSELQLFQAGRKIYRSNQVEKFTNHRSSVSPLQKISSSFTTHIFNKYRNDLIDFPLLPQEEKAYIRGKSYEYECSEDGEVFRVPASLTNHQVIHTAEKPYKCTECGKVFSRNSHLVEHWRIHTGQKPYKCSECDKVFNRNSNLARHQRIHTGEKPHKCNECGKAFRECSGLTTHLVIHTGEKPYKCNECGKNFRHKFSLTNHQRSHTAEKPYKCNECGKVFSLLSYLARHQIIHSTEKPYKCNECGRAFHKRPGLMAHLLIHTGEKPYKCNECDKVFGRKLYLTNHQRIHTGERPYKCNACGKVFNQNPHLSRHRKIHAGENSLRTLQME

SEQ ID NO: 3572 - protein, 298 aa, Homo sapiens
MSRPRGERKRILVWLEECAEKQGQIERVIKEKKAVEEELEKIYREGRGNECDYRKLEEMHQRFLVSERSKDDLQLRLTRAENRIKQLETDSSEEISRYQEMIQKLQNVLESERENCGLVSEQRLKLQQENKQLRKETESLRKIALEAQKKAKVKISTMEHEFSIKERGFEVQLREMEDSNRNSIVELRHLLATQQKAANRWKEETKKLTESAEIRINNLKSELSRQKLHTQELLSQLEMANEKVAENEKLILEHQEKANRLQRRLSQAEERAASASQQLSVITVQRRKAASLMNLENI

SEQ ID NO: 3573 - protein, 331 aa, Homo sapiens [sequence omitted]

SEQ ID NO: 3574 - protein, 515 aa, Homo sapiens
MARCRHHSGYLADDEASHSMCSARVQLPKKPLVPEMRPACKPGRVPHPPSTCGSSALQGQRRNKRHPQPFGHFLDFLTESQVLDSLETVVEKATERMAAMKTEAGVPLVEVQDPVEVPSGGRRAHARPSLSTVHRHRVRPTLCTGHPNNYPSSSSSMSNCHSSLMAGCLGSHSRDSDLGAQGSLPPVRDKLLLEKNLKRLLQLEREGKGLSQSCSQRDSLLWDSLGSQTSFQWTQEQPLSWFSGLLGSSSGVPEASEPRPGEQEPIFRKREFNKEIKSLLSQLESLDLPGYCPLREPHRTLNFLADHRLFPALQSVVSQAVDKLRGAHCRDGRPLFPTSLEPTSDLPPLGSEPAKPTNGGQPYASPRPTVSSPKMLQRKRKDRGGSPSMSSAQVATRFKLKSPCSSSRFTKKKPLPSISSKSSMSHFSNRLYEELADFLTQQAASLVIRKYEFEKDLSKQLGFFSFPITHVLRDLSLGLKKVKGSRIHLSSETHRSCLLRKLEESKRAAAVSLEA

SEQ ID NO: 3575 - protein, 113 aa, Homo sapiens
MPAMGNRPGTQEHTGPGVDPLGEAGNRPAHRWRNLVPVTEACGGSSTPGSLVRHPPATSSPTSPSLGSLDPEGAKSQEPGKLHCANILTLFVSFQEPHRHIQVKRSLNKCLQP

SEQ ID NO: 3576 - protein, 231 aa, Homo sapiens
MLKKKRIKDRTIVKRNRLQDSNQKLIDIAIGEEKCSDNYEAQAEKNQGQSEGNQHQSEGNPDKSEESQGQPEENHHSERSRNHLERSLSQSDRSQGQLKRHHPQYERSHGQYKRSHGQSERSHGHSERSHGHSERSHGHSERSHGHSKRSRSQGDLVDTQSDLIATQRDLIATQKDLIATQRDLIATQRDLIVTQRDLVATERDLINQSGRSHGQSERHQRYSTGKNTITT

SEQ ID NO: 3577 - protein, 148 aa, Homo sapiens [sequence omitted]

SEQ ID NO: 3578 - protein, 374 aa, Homo sapiens
MASGQLSAPASPTVGASPWPVRGQGCRSGGLTPALGLPGVGLVLRVEQQPHLPLLSTLAGIRVMVHGRNHTPFLGHHSFSVRPGTEATISIREDEVHRLGSPYGHCTAGGEGVEVELLHNTSYTRQACLVSCFQQLMVETCSCGYYLHPLPAGAEYCSSARHPAWGHCFYRLYQDLETHRLPCTSRCPRPCRESAFKLSTGTSRWPSAKSAGWTLATLGEQGLPHQSHRQRSSLAKINIVYQELNYRSVEEAPVYSVPQLLSAMGSLCSLWFGASVLSLLELLELLLDASALTLVLGGRRLRRAWFSWPRASPASGASSIKPEASQMPPPAGGTSDDPEPSGPHLPRVMLPGVLAGVSAEESWAGPQPLETLDT

SEQ ID NO: 3579 - protein, 383 aa, Homo sapiens
MSGRGESTQSSLSKTDRAMRFMSAACCGWGQRGRAGPSSSPFLVSQRHLVSQRHLVSQCPTGRRGRPRGRMKNHSLRACRECPRGLEETWDLLSQLQSLLGPHLEKGDFGQLSGPDPPGEVGKRTPDGASRSSHEPMEDAAPIVSPLASPDPRTKHPQDLASTPPPGPMTTSVSSLSASQPPEPSLLLERPSPEPPALFPHPPHTPDPLACSPPPPKGFTPPPLRDSTLLTPSHCDSVALPLDTVPQSLSPREDLAASAPAISGLGGSNSQVSALSWSQETTKTWCIFNSSVQQDHLSRQRDTTMSPLLFQAQPLSHLGPESQPFISSTPQFRPTPMAQAEAQAHLQSSFPVLSPAFLSPMKNTGVACPASQNKVQALSLPET

SEQ ID NO: 3580 - protein, 566 aa, Homo sapiens
MAHLRSPSGFGDPGKKDQKESEQELEAPETFSEEYLWKVTDIGDYDDDFPDVRPRLASIVSPSLTSTFVPSQSATSTETPSASPPSSTSSHKSFPKIFQTFRKDMSEMSIDRNIHRNLSPGIPVSVQTEESWLQDLSDKVQSRKKASKEKAEPECLASKLREKWVINPEESKLNILYELEFKEDFITLFEPSLRTLPSIGPPSILAYKEESSNLGINFKDEEEETSPKCEFCGSDLRAFFSNVDVSSEPKGHASCCIAFQNLIDYIYEEQIKTKPPKAELIAIDPHAAHGSEVDRLKAKEKALQRKQEQRMARHFAIISREQTHFSEDDSKRLKTISYQLSVDIPEKQIIDDIVFDFQLRNSNMSIICCDSRIACGKVVRNELLEKHYKHGSKFLTSFPDGTTQIFYPSGNLAIIRVPNKVNGFTCIVQEDMPTNPAILAVLDSSGRSSCYHPNGNVWVYINILGGQYSDQAGNRIRAWNWSNSITSSPFVSFKPVFLALNRYIGVRILEQDKISITFLAMGQQARISVGTKVKLPNPEEIPILRYVSGDDLLLLASLIKIRRLFH

SEQ ID NO: 3581 - protein, 405 aa, Homo sapiens [sequence omitted]

SEQ ID NO: 3582 - protein, 526 aa, Homo sapiens [sequence omitted]

SEQ ID NO: 3583 - protein, 177 aa, Homo sapiens
METNYLKRCFGNCLAQALAEVAKVRPSDPIEYLAHWLYHYRKTAKAKEENREKKIHLQEEYDSSLKEMEMTEMLKQEEYQIQQNCEKCHKELTSETVSTKKTIFMQEDTNPLEKEALKQEFLPGTSSLIPGMPQQVPPSESAGQIDQNFKMPQEINYKEAFQHEVAHEMPPGSKSPF

SEQ ID NO: 3584 - protein, 461 aa, Homo sapiens [sequence omitted]

SEQ ID NO: 3585 - protein, 192 aa, Homo sapiens
MKKVKKKRSEARRHRDSTSQHASSNSTSQQPSPESTPQQPSPESTPQQPSPESTPQHSSLETTSRQPAFQALPAPEIRRSSCCLLSPDANVKAAPQSRKAGPLIRAGPHSCSCATCPCSSACWRRLGLCHSRIFDVLLPRDWQMAPGRGLPNLLTFYRKSSRKPSSHRNACPPSPRNCGCGSGGSRSCLLHH

SEQ ID NO: 3586 - protein, 681 aa, Homo sapiens
MADPVAGIAGSAAKSVRPFRSSEAYVEAMKEDLAEWLNALYGLGLPGGGDGFLTGLATGTTLCQHANAVTEAARALAAARPARGVAFQAHSVVPGSFMARDNVATFIGWCRVELGVPEVLMFETEDLVLRKNEKSVVLCLLEVARRGARLGLLAPRLVQFEQEIERELRAAPPAPNAPAAGEDTTETAPAPGTPARGPRMTPSDLRNLDELVREILGRCTCPDQFPMIKVSEGKYRVGDSSLLIFVRVLRSHVMVRVGGGWDTLEHYLDKHDPCRCSSTAHRPPQPRVCTFSPQRVSPTTSPRPASPVPGSERRGSRPEMTPVSLRSTKEGPETPPRPRDQLPPHPRSRRYSGDSDSSASSAQSGPLGTRSDDTGTGPRRERPSRRLTTGTPASPRRPPALRSQSRDRLDRGRPRGAPGGRGAQLSVPSPARRARSQSREEQAVLLVRRDRDGQHSWVPRGRGSGGSGRSTPQTPRARSPAAPRLSRVSSPSPELGTTPASIFRTPLQLDPQQEQQLFRRLEEEFLANARALEAVASVTPTGPAPDPARAPDPPAPDSAYCSSSSSSSSLSVLGGKCGQPGDSGRTANGLPGPRSQALSSSSDEGSPCPGMGGPLDAPGSPLACTEPSRTWARGRMDTQPDRKPSRIPTPRGPRRPSGPAELGTWHALHSVTPRAEPDSWM

SEQ ID NO: 3587 - protein, 354 aa, Homo sapiens
MPLEERRSSGERNDAAPTNHRRPGEKRTSTAKQVSSVPFLGAAGHQQSLPSSWKASCSGPLVMASDSDVKMLLNFVNLASSDIKAALDKSAPCRRSVDHRKYLQKQLKRFSQKYSRLPRGLPGRAAEPYLKRGSEDRPRRLLLDLGPDSSPGGGGGCKEKVLRSPYREECLAKEQLPQRQHPEAAQPGQVPMRKRQLPASFWEEPRPTHSYHVGLEGGLGPREGPPYEGKKNCKGLEPLGPETTLVSMSPRALAEKEPLKMPGVSLVGRVNAWSCCPFQYHGQPIYPGPLGALPQSPVPSLGLWRKSPAFPGELAHLCKDVDGLGQKVCRPVVLKPIPTKPAVPPPIFNVFGYL

SEQ ID NO: 3588 - protein, 312 aa, Homo sapiens
MPPEPRQGSRADPQAEGSALGPPGPSLWEGTDSQQPHPRMKPSPLTPCPPGVPSPSPPPHKLELQTLKLEELTVSELRQQLRLRGLPVSGTKSMLLERMRGGAPPRERPKPRREDSPAGAPWPRLKPKALAAARRQGSVKPSAASHRPPLPRAADTPGTAPAPTPTPAPAAAPALTPSSGPGSAALTLEEELQEAIRRAQLLPNRGIDDILEDQVEPDDPLPPIPLDFPGSFDVLSPSPDSEGLSSVFSSSLPSPTNSSSPSPRDPTDSLDWLEALSGGPPLGSGPPPPSIFSADLSDSSSSRLWDLLEDPW

SEQ ID NO: 3589 - protein, 224 aa, Homo sapiens
MSVGYANGIRVMSMTHTGEPGFMLYIPIEYALHVYNEVMSVGQKYGIRNAGYYALRSLRIEKFFAFWGQDINNLTTPLECGRESRVKLEKGMDFIGRDALLQQKQNGVYKRLTMFILDDHDSDLDLWPWWGEPIYRNGQYVGKTTSSAYSYSLERHVCLGFVHNFSEDTGEEQVVTADFINRGEYEIDIAGYRFQAKAKLYPVASLFTQKRRKDDMELSDLHGK

SEQ ID NO: 3590 - protein, 258 aa, Homo sapiens
MFSGTHVERDFVEAPSQMLENWVWEQEPLLRMSRHYRTGSAVPRELLEKLIESRQANTGLFNLRQIVLAKVDQALHTQTDADPAEEYARLCQEILGVPATPGTNMPATFGHLAGGYDAQYYGYLWSEVYSMDMFHTRFKQEGVLNSKFPHYEVRPLRHVSLCLPLTWCDPGSGQPPESLTRNRWLPALRAGPALPGCNIALGSLQVGMDYRSCILRPGGSEDASAMLRRFLGRDPKQDAFLLSKGLQVGGCEPEPQVC

SEQ ID NO: 3591 - protein, 484 aa, Homo sapiens
MTNIGVYVSNMTDKLVTPGKYFSAAEYHAQRLKAVIVIQTYYRQWHAKIFVENLRRQKSLRLEWETQQELRKIREKEEWIKLDYHRRHNPKTNEDFEFLYNALEFWRQEELTRINQSFTGAERKAALCELLEKETQIIASIGRHRYIAYMANQEAAIQAFLDKCSAPKIWRTPNGKTIEMDTQFTIRARELQNIYKCIMLKNISQDERLDVLLTLKHTVKEHECKLTQEILELIDREVDLMMRGVKHHNLEGLRKRIATLFFHYIKTPLFNPEVAKYLKVPQDPLKFYKKIYFCHSCQLYLPSTEFSVSSTSRRIYRCRNCINLQNEAQKRESFLKYKCLLQQLYYTEADYEDDSKIAFLMQLQDIQYLTENIWASQSVLSACDNLSDLVMVRWNKSLEWSPWNCILLTKDEAAAHLKLTSIEEGYERSFIHKIKHKHILAKNYFSQVPVLASFILDDGEIDEIRWKYHSDTTPKIIESQRPPH

SEQ ID NO: 3592 - protein, 223 aa, Homo sapiens; identical to SEQ ID NO: 2715

SEQ ID NO: 3593 - protein, 269 aa, Homo sapiens
MKSHTDERPHKCHLCGRAFRTVTLLRNHLNTHTGTRPHKCPDCDMAFVTSGELVRHRRYKHTHEKPYACSHCDKTFRQKQLLDMHFKRYHDPNFVPAAFVCSKCGKTFTRRDTMARHADNCAGPDGVEGENGGETKKSKRGRKRKMRSKKEDSSDSENAEPDLDDNEDEEEPAVEIEPEPEPQPVTPAPPPAKKRRGRPPGRTNQPKQNQPIIQVEDQNTGAIENIIVEVKKEPDAEPAEGEEEEAQPAATDAPNGDLTPEMILSMMDR

SEQ ID NO: 3594 - protein, 510 aa, Homo sapiens
MLLLSCQARLVMYIERDSRKTTPGKEQQSGNEYLSKCLDLLICHIVQELPRILGDILNSLANVSGRKHPSTVQVKQLKLCLPLMPVVLHLVTSQVFRPQVVTEEFLFSYGTILSHIKSVDSGETNIDGAIGLTASEEFIKITLSAFEAIIQYPILLKDYRSTVVDYILPPLVSLVQSQNVEWRLFSLRLLSETTSLLVNQEFGDGKEKASVDSDSNLLALIRDVLLPQYEHILLEPDPVPAYALKLLVAMTEHNPTFTRLVEESKLIPLIFEVTLEHQESILGNTMQSVIALLSNLVACKDSNMELLYEQGLVSHICNLLTETATLCLDVDNKNNNEMAAPLLFSLLDILHSMLTYTSGIVRLALQAQKSGSGEDPQAAEDLLLLNRPLTDLISLLIPLLPNEDPEIFDVSSKCLSILVQLYGGENPDSLSPENVEIFAHLLTSKEDPKEQKLLLRILRRMITSNEKHLESLKNAGSLLRALERLAPGSGSFADSAVAPLALEILQAVGH

SEQ ID NO: 3595 - protein, 139 aa, Homo sapiens
MSPTYLPGSLPLSFSQVAVFFHSPAGTHTGSPAPILSTPSHLPGSPSSPSPVDRSFPRHTCPTLTSWHGEAVTPFSPGSHVLSRHKFTRTFLDLALSQKALPLQWQIPVLIAVQVTHTYHVLACSRHRWLSFLFCVRFQ

SEQ ID NO: 3596 - protein, 331 aa, Homo sapiens [sequence omitted]

SEQ ID NO: 3597 - protein, 112 aa, Homo sapiens [sequence omitted]

SEQ ID NO: 3598 - protein, 101 aa, Homo sapiens [sequence omitted]

SEQ ID NO: 3599 - protein, 146 aa, Homo sapiens [sequence omitted]

SEQ ID NO: 3600 - protein, 193 aa, Homo sapiens
MFQIKTLRKKNQKYHERNSRLKEEQIWHIRHLLKELSEEKAEGLPVVTREDVEEAMKEKWKFERDQEKNLRDMRMQISNAEKLFLEKLSEKEYWEEYKNVGSERHAKLITSLQNDINTVKENAEKMSEHYKITLEDTRKKIIKETLLQLDQKKEWATQNAVKLIDKGSYLEIWENDWLKKENRLQFTGRKLKN

SEQ ID NO: 3601 - protein, 113 aa, Homo sapiens
MILAGAQPHPRPRRFLFSCCCHIPRSRGSPGAMEPQCQFPDKPSSKKAFPLQNEQVLRENRERNFCFSPMHFSRSSDNVQNKKSTLEIYHEVILYFNSLLFSPCENLILLVLY

SEQ ID NO: 3602 - protein, 230 aa, Homo sapiens
MLPPAIHFYLLPLACILMKSCLAFKNDATEILYSHVVKPVPAHPSSNSTLNQARNGGRHFSNTGLDRNRTESLTRQNYFWLFPGAFLRQLQEARVQVGCRELRSTKYISDGQCTSISPLKELVCAGECLPLPVLPNWIGGGYGTKYWSRRSSQEWRCVNDKTRTQRIQLQCQDGSTRTYKITVVTACKCKRYTRQHNESSHNFESMSPAKPVQHHRERKRASKSSKHSMS

SEQ ID NO: 3603 - protein, 497 aa, Homo sapiens
MTNPPVEVRKNMEVFLPQSYCAFDFATMPHQLQDTFLRIPLLVELWHKDKMSKDLLLGIARIQLSNILSSEKTRFLGSNGEQCWRQTYSESVPVIAAQGSNNRIADLSYTVTLEDYGLVKMREIFISDSSQGVSAVQQKPSSLPPAPCPSEIQTEPRETLEYKAALELEMWKEMQEDIFENQLKQKELAHMQALAEEWKKRDRERESLVKKKVAEYTILEGKLQKTLIDLEKREQQLASVESELQREKKELQSERQRNLQELQDSIRRAKEDCIHQVELERLKIKQLEEDKHRLQQQLNDAENKYKILEKEFQQFKDQQNNKPEIRLQSEINLLTLEKVELERKLESATKSKLHYKQQWGRALKELARLKQREQESQMARLKKQQEELEQMRLRYLAAEEKDTVKTERQELLDIRNELNRLRQQEQKQYQDSTEIASGKKDGPHGSVLEEGLDDYLTRLIEERDTLMRTGVYNHEDRIISELDRQIREILAKSNASN

SEQ ID NO: 3604 - protein, 125 aa, Homo sapiens
MTLLGICPRGMKASIPCKLILTQQRDSRRPKAETPQTSISGQTGRCNALSVPWDVTQPYEGKTPVWMSPGTTVLRDPVTHGQNRHGPEPEAGRMRAGGGETEGRWPSFFWAENGLKLTVVMAVQL

SEQ ID NO: 3605 - protein, 618 aa, Homo sapiens [sequence omitted]

SEQ ID NO: 3606 - protein, 264 aa, Homo sapiens
MRPEGSLTYRVPERLRQGFCGVGRAAQALVCASAKEGTAFRMEAVQEGAAGVESEQAALGEEAVLLLDDIMAEVEVVAEVEVVAEEEGLVERREEAQRAQQAVPGPGPMTPESALEELLAVQVELEPVNAQARKAFSRQREKMERRRKPHLDRRGAVIQSVPGFWANVIANHPQMSALITDEDEDMLSYMVSLEVGEEKHPVHLCKIMLFFRSNPYFQNKVITKEYLVNITGDRWLPGWVVGGRWWVDHCQRDPAPFPQKLLSL

SEQ ID NO: 3607 - protein, 543 aa, Homo sapiens
MASPDRSKRKILKAKKTMPLSCRKQVEMLNKSRNVEALKTAIGSNVPSGNQSFSPSVITRTTEITKCSPSENGASSLDSNKNSISEKSKVFSQNCIKPVEEIVHSETKLEQVVCSYQKPSRTTESPSRVFTEEAKDSLNTSENDSEHQTNVTRSLFEHEGACSLKSSCCPPSVLSGVVQMPESTVTSTVGDKKTDQMVFHLETNSNSESHDKRQSDNILCSEDSGFVPVEKTPNLVNSVTSNNCADDILKTDECSRTSISNCESADSTWQSSLDTNNNSHYQKKRMFSENEENVKRMKTSEQINENICVSLERQTAFLEQVRHLIQQEIYSINYELFDKKLKELNQRIGKTECRNKHEGIADKLLAKIAKLQRRIKTVLLFQRNCLKPNMLSSNGASKVANSEAMILDKNLESVNSPIEKSSVNYEPSNPSEKGSKKINLSSDQNKSVSESNNDDVMLISVESPNLTTPITSNPTDTRKITSGNSSNSPNAEVMKVQYPPWSHIRKLLQTQRKQPHWHKMQSRFLSPLSTCHLSQNHQHHYLN

SEQ ID NO: 3608 - protein, 115 aa, Homo sapiens
MKTPSSISTSWNLAVLIPAPSHVLSASTLQPSRKKDIFPPLPDQKANTKSSALPANSSGVLSATLLGMKVLTARSTKKETNCCVTGPAKLSMGRGMPRSVQSARSTSSELKDVTI

SEQ ID NO: 3609 - protein, 360 aa, Homo sapiens
MLRRHMEFRKQQDLDNIVTWQPPEVIQLYDSGGLCGYDYEGCPVYFNIIGSLDPKGLLLSASKQDMIRKRIKVCELLLHECELQTQKLGRKIEMALMVFDMEGLSLKHLWKPAVEVYQQFFSILEANYPETLKNLIVIRAPKLFPVAFNLVKSFMSEETRRKIVILGDNWKQELTKFISPDQLPVEFGGTMTDPDGNPKCLTKINYGGEVPKSYYLCEQVRLQYEHTRSVGRGSSLQVENEILFPGCVLRWQFASDGGDIGFGVFLKTKMGEQQSAREMTEVLPSQRYNAHMVPEDGSLTCLQAGVYVRGLCSLITSPSLQMSCASTTPTAGCMPRSSATLWRCCFPTRPLRRRCRVSRR

SEQ ID NO: 3610 - protein, 158 aa, Homo sapiens [sequence omitted]

SEQ ID NO: 3611 - protein, 669 aa, Homo sapiens [sequence omitted]

SEQ ID NO: 3612 - protein, 138 aa, Homo sapiens
MRPTADSFRLKKGNVFPNFDPCAQALQKSCHFALSFLIGKMGIIILSVCLICTRLLQEGIAQSKCLINVSFSLYSCFIVFVTISQDSETLSLDCDHRLFFSLPFTDPASGGQSQHSWPCPERSKNLPQVSKQLRNRAG

SEQ ID NO: 3613 - protein, 201 aa, Homo sapiens
MPLQLKNPRLRQKSRTRCNKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKVKTDTVLILCRKKVENTRWDYLTQVEKECKEKEKPSYDTETDPSEGLMNVLKKIYEDGDDDMKRTINKAWVESREKQAKGDTEF

SEQ ID NO: 3614 - protein, 120 aa, Homo sapiens
MHGPRPTSQSEWGQGSHLFPLRVPTCRWPALPQRHPWVAACINCKVHKVLNKLLNVLANTAPAVFPTDLQAGKARLPQPEGCPSKLYRLMQRCWALSPKDRPSFSEIASALGDSTVDSKP

SEQ ID NO: 3615 - protein, 106 aa, Homo sapiens [sequence omitted]

SEQ ID NO: 3616 - protein, 283 aa, Homo sapiens
MPVESVGAMEPLPGALQWGVQATLERGRGPLWRRLPGAMGSRQKAATEGPAQVRAARPKTLYSPWTVPTSAHTAVPTSGTAFSVCRDPAAQAAAVPLASWSRMGAVCRSPLAAVASPVPMPLGSWPRPRRCSWTAKTAPVSTSPWCAHTRSVQFLGLGQPGAVARPPVVGALWSDVGLVRGVLGWHHARPRTQSNGRSVTCSPALSAPLARCLVPVPPHARASAGICSLVPSVCRSPASLAVAALEGSVCHGGAFSCSLVDCQGEMWLSMPCCTSKVKARDWH

SEQ ID NO: 3617 - protein, 573 aa, Homo sapiens
MPLSRRGRGSRLAGSRAATSNLPRATALSPKSAGRGALSISHAQLLTRRRHSSEQVPPESEPRADFRSGKWLQEPATGDARDSRQALRARMSSKHRICSQEEVVIPCAYDSDSESVDLELSNLEIIKKGSSSIELTDLDIPDIPGLHCEPLSHSPRHLTQQDPLSEAIVEKLIQSIQKVFNGELKGELEKLKFLGDLSSLSQALPYDETAKSFIHSHIADIVHTLNVLVQEERPHSLSSSMRQEVFVTIADLSYQDVHLLLGSEDRAELFSLTIKSIITLPSVRTLTQIQEIMPNGTCNTECLYRQTFQAFSEMLQSLVVKDPHLENLDTIIKLPLRFQRLGHLVALMALLCGDPQEKVAEEAAEGIHSLLHITLRLKYITHDKKDQQNLKRALTKCREFLELHSSAAKCFYNCPFRIAQVFEGFLDSNELCQFIMTTFDTLKNLKHPCIQRSAGELLLTLAKNTESQFEKVPEIMGVICAQLSIISQPRVRQQIINTVSLFISRPKYTDIVLSFLLCHPVPYNRHLAEVWRMLSVELPSTTWILWRLLRKLQKCHNEPAQEKMAYVAVAVSP

SEQ ID NO: 3618 - protein, 666 aa, Homo sapiens
MTGTPKTQEGAKDLEVDMNKTEVTPRLWTTCRDGEVLLRLSKHGPGHETPMTIPEFFRESVNRFGTYPALASKNGKKWEILNFNQYYEACRKAAKSLIKLGLERFHGVGILGFNSAEWFITAVGAILAGGLCVGIYATNSAEVCQYVITHAKVNILLVENDQQLQKILSIPQSSLEPLKAIIQYRLPMKKNNNLYSWDDFMELGRSIPDTQLEQVIESQKANQCAVLIYTSGTTGIPKGVMLSHDNITWIAGAVTKDFKLTDKHETVVSYLPLSHIAAQMMDIWVPIKIGALTYFAQADALKGTLVSTLKEVKPTVFIGVPQIWEKIHEMVKKNSAKSMGLKKKAFVWARNIGFKVNSKKMLGKYNTPVSYRMAKTLVFSKVKTSLGLDHCHSFISGTAPLNQETAEFFLSLDIPIGELYGLSESSGPHTISNQNNYRLLSCGKILTGCKNMLFQQNKDGIGEICLWGRHIFMGYLESETETTEAIDDEGWLHSGDLGQLDGLGFLYVTGHIKEILITAGGENVPPIPVETLVKKKIPIISNAMLVGDKLKFLSMLLTLKCEMNQMSGEPLDKLNFEAINFCRGLGSQASTVTEIVKQQDPLVYKAIQQGINAVNQEAMNNAQRIEKWVILEKDFSIYGGELGPMMKLKRHFVAQKYKKQIDHMYH

SEQ ID NO: 3619 - protein, 575 aa, Homo sapiens
MGSDPTNQIDALAKKLKLECRTISMGQGQEVHARKLIQMSMQQGGWVLLQNCHLGLEFMEELLETLITTEASDDSFRVWITTEPHDRFPITLLQTSLKFTNEPPQGVRAGLKRTFAGINQDLLDISNLPMWKPMLYTVAFLHSTVQERRKFGPLGWNIPYEFNSADFSASVQFIQNHLDECDIKKGVSWNMVRYMIGEVQYGGRVTDDFDKRLLNCFARVWFSEKMFEPSFCFYTGYKIPLCKTLDQYFEYIQSLPSLDNPEVFGLHPNADITYQSNTASAVLETITNIQPKESGGGVGETREAIVYRLSEDMLSKLPPDYIPHEVKSRLIKMGHLNSMNIFLRQEIDRMQRVISTLRSSLSDLKLAIEGTIIMSENLRDALDNMYDARIPQLWKRVSWDSSTLGFWFTELLERNAQFSTWIFEGRPNVFWMTGFFNPQGFLTAMRQEVTRAHKGWALDTVTVHNEVLRQTKEEITSPPGEGVYIYGLYMDGAAWDRRNGKLMESTPKVLFTQLPVLHIFAINSTAPKDPKLYVCPIYKKPRRTDLTFITVVYLRTVLSPDHWILRGVALLCDIK

SEQ ID NO: 3620 - protein, 169 aa, Homo sapiens
MSLRGRFYYCRHFRGRKQARRVGELPEVTELVSGPDWNPNTSQPMPGSPAPAPRRLPGCQRHPHPFKCCPVPAPQSLPSTTRPHLPPTPQGQASRWLFLFLFQKLRGETDVCVPDACRWRRRSRETRGENQSVRAAVRSPDQAFHALVSGSRGREGRLRPQCAGSAGGA

SEQ ID NO: 3621 - protein, 404 aa, Homo sapiens
MGSSQEEGLRCQPSQPDHDADGHCGPDLEGAERASATPGPPGLLNSHRPADSDDTNAAGPSAALLEGLLLGGGKPSPHSTRPGPFFYIGGSNGATIISSYCKSKGWQRIHDSRRDDYTLKWCEVKSRDSYGSFREGEQLLYQLPNNKLLTTKIGLLSTLRGRARAMSRASKVPGGVQARLEKDAAAPALEDLPWTSPGYLRPQRVLRMEEFFPETYRLDLKHEREAFFTLFDETQIWICKPTASNQGKGIFLLRNQEEVAALQAKTRSMEDDPIHHKTPFRGPQARVVQRYIQNPLLVDGRKFDVRSYLLIACTTPYMIFFGHGYARLTLSLYDPHSSDLGGHLTNQFMQKKSPLYMLLKEHTVWSMEHLNRYISDTFWKARGLAKDWVFTTLKVRPLCPPVWE

SEQ ID NO: 3622 - protein, 575 aa, Homo sapiens [sequence omitted]

SEQ ID NO: 3623 - protein, 275 aa, Homo sapiens [sequence omitted]

SEQ ID NO: 3624 - protein, 139 aa, Homo sapiens
MRSHTQEDPFLCNDLGEDFTQHIALTQNVITYMRTKHFVSKKFGKIFSDWLSFNQHKEIHTKCKSYGSHLFDYAFIQNSALRPHSVTHTREITLECRVCGKTFSKNSNLRRHEMIHTGEKPHGCHLCGKAFTHLIIVNT

SEQ ID NO: 3625 - protein, 563 aa, Homo sapiens [sequence omitted]

SEQ ID NO: 3626 - protein, 475 aa, Homo sapiens
MAASALRGLPVAGGGESSESEDDGWEIGYLDRTSQKLKRLLPIEEKKEKFKKAMTIGDVSLVQELLDSGISVDSNFQYGWTPLMYAASVANAELVRVLLDRGANASFEKDKQSILITACSAHGSEEQILKCVELLLSRNADPNVACRRLMTPIMYAARDGHTQVVALLVAHGAEVNTQDENGYTALTWAARQGHKNIVLKLLELGANKMLQTKDGKMPSEIAKRNKHHEIFNLLSFTLNPLEGKLQQLTKEDTICKILTTDSDREKDHIFSSYTAFGDLEVFLHGLGLEHMTDLLKERDITLRHLLTMREDEFTKNGITSKDQQKILAALKELQVEEIQFGELSEETKLEISGDEFLNFLLKLNKQCGHLITAVQNVITELPVNSQKITLEWASPQNFTSVCEELVNNVEDLSEKVCKLKDLIQKLQNERENDPTHIQLREEVSTWNSRILKRTAITICGFGFLLFICKLTFQRK

SEQ ID NO: 3627 - protein, 275 aa, Homo sapiens
MVPEDISELETAQKLLEYHRNIVRVIPSYPKILKVISADQPCVDVFYQALTYVQSNHRTNAPFTPRVLLLGPVGSGKSLQAALLAQKYRLVNVCCGQLLKEAVADRTTFGELIQPFFEKEMAVPDSLLMKVLSQRLDQQDCIQKGWVLHGVPRDLDQAHLLNRLGYNPNRVFFLNVPFDSIMERLTLRRIDPVTGERYHLMYKPPPTMEIQARLLQNPKDAEEQVKLKMDLFYRNSADLEQLYGSAITLNGDQDPYTVFEYIESGIINPLPKKIP

SEQ ID NO: 3628 - protein, 305 aa, Homo sapiens
MLSSFLSPQNGTWADTFSLLLALAVALYLGYYWACVLQRPRLVAGPQFLAFLEPHCSITTETFYPTLWCFEGRLQSIFQVLLQSQPLVLYQSDILQTPDGGQLLLDWAKQPDSSQDPDPTTQPIVLLLPGITGSSQETYVLHLVNQALRDGYQAVVFNNRGCRGEELRTHRAFCASNTEDLETVVNHIKHRYPQAPLLAVGISFGGILVLNHLAQARQAAGLVAALTLSACWDSFETTRSLETPLNSLLFNQPLTAGLCQLVERLSYGKTCRPVQSASLMSATHLWPLDIKTVLPTTKQQALEPR

SEQ ID NO: 3629 - protein, 422 aa, Homo sapiens
MKKNTSKTTMRINKQDALCTPHSHDPRDLQNMLDGGEYAPFVSPPMLESNFIQVNRRGESIYLHNRANWVTVGICFSSSTHKIPNVMLLAHPTPGAQKDTETLFKSLLTSPPAEKLVLTRFLPLQFVTLSVHDAENMSLKVKLVSGRAYYLQLCTSAYKQDTLFSQWVALISLLNQEKAKVSKVSEVSSLSGITNSTDITGSMDVTDVTTFTAILTPYMYAGTGPEHVRDSIDFPEFTDITDITDVTDLPENEVPEVPDVRIVTEVIEVREATEVTDSSDITNCSGVTVVFENNDLIRAKQEEKEKLKNILKPGCLQDTKSKSELKESSKHVTISNITLTFEGKRYFQTTLTPVESEANTSKEMKDKTSEEKMPDFQSTALKAEESRSLRTESNTSVLSPHIKSPSNFLKLVPHLSAPFSRE

SEQ ID NO: 3630 - protein, 124 aa, Homo sapiens
MYVSISFLLGLSHLVLCCLLTFIVNFYLPPESIDFEFMAHNWSKGRSPSSTLGLSWFKAGFRFSDGWSMFYSFGLPGVALPGSPPRSHLLPGTQILIRSFQPCESAKHSARLSSLLTTTSYSVS

SEQ ID NO: 3631 - protein, 101 aa, Homo sapiens
MAGLPGTKWRNDRGVTLTPQPPSVCRREKYYNGDYSYTHTHTHTHTQSSCHRWNSLSLSFISHIHVQIPLRCITREPSEVNNEWMVFTKKPAYGRGPVTIL

SEQ ID NO: 3632 - protein, 339 aa, Homo sapiens [sequence omitted]

SEQ ID NO: 3633 - protein, 160 aa, Homo sapiens [sequence omitted]

SEQ ID NO: 3634 - protein, 608 aa, Homo sapiens
MLPLLDSSKRAGTLGSGCGVPRVHSAALSREEGASRDIWRIKVWARVMTTPAGSGSGFGSVSWWGLSPALDLQAERDATVDALPTTMVPQPAVILPGPPVDPDSQADTVHSNPELDVLLLGSVDGRHLLRTLSRAKFWPRRRFNFFVLENNLEAVARHMLIFSLALEEPEKMGLQERSETFLEVWGNALLRPPVAAFVRAQADLLAHLVPEPDRLEEQLPWLSLRALKFRERDALEAVFRFWAGGEKGPQAFPMSRLWDSRLRHYLGSRYDARRGVSDWDLRMKLHDRGAQVIHPQEFRRWRDTGVAFELRDSSAYHVPNRTLASGRLLSYRGERVAARGYWGDIATGPFVAFGIEADDESLLRTSNGQPVKTAGEITQHNVTELLRDVAAWGRARATGGDLEEQQHAEGSPEPGTPAPTPESFTVHFLPLNSAQTLHHKSCYNGRFQLLYVACGMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGTPHCEPCQLPSESPGSLSEVLAQPQGALAPPNCESDSKTGV

SEQ ID NO: 3635 - protein, 321 aa, Homo sapiens
MYHALGYSTIVVLQAVLTFEQQDIQNGISAMKDALQTCQKYRKKYTVVESFSSLLSRGSLEQLSEEEMHAEICYAECLLQKAALTFVQDENMINFIKGGLKIRTSYQIYKECLSILHEIQKNKLQQEFFYEFEGGVKLGSGAFNLMLSLLPARIIRLLEFIGFSGNRELGLLQLREGASGRSMRSALCCLTILAFHTYISLILGTGEVNVAEAERLLAPFLQQFPNGSLVLFYHARIELLKGNLEEAQEVFQKCVSVQEEWKQFHHLCYWELMWINVFQQNWMQAYYYSDLLCKESKWSNLCVLESSNFEYASRGGCSSNE

SEQ ID NO: 3636 - protein, 650 aa, Homo sapiens
MWPQPHLPPHPMMSEKTRQNKLAEAKKKFTDYRQWNIAGVGTGATDTKKKKINHGTNPETTTSGGCHSPEDTQQNRAQLKEEKKASHQHQEALRREIEAQDHTIRILTCQKTELETALYYSQDAARKFEDGNLGTPSSFNLALSQAFRGSPLGCVSTSLIPGESKDLAGRLHHSWHFAGELQRALSAVSTRHKKADRYIEELTKERDALSLELYRNTITNEELKKKNAELQEKLPLAESEKSEIQLNVKELKRKLERAKFLLPQVQTNTLQEEMWRQEEELREQEKKIRKQEEKMWRQEERLREQEGKMREQEEKMWRQEKRLREQEKELREQEKELREQKKLREQEEQMQEQEEKMWEQEEKMREQEEKMWRQEERLWEQEKQMREQEQKMRDQEERMWEQDERLREKEERMREQEKMWEQVEKMREEKKMQEQEKKTRDQEEKMQEEERIREREKKMREEEETMREQEEKMQKQEENMWEQEEKEWQQQRLPEQKEKLWEQEKMQEQEEKIWEQEEKIRDQEEMWGQEKKMWQEEKMWGQEEMMREKEERIRDQKEKMQERLPEHEERCSEPCLPPSKVLCNMSHTGSVEPAGGEAGEGSPQDNPTAQEIMQLFCGMKNAQQCPGLGSTSCIPFFYRGDKRKMKIINI

SEQ ID NO: 3637 - protein, 402 aa, Homo sapiens
MQENPEAWAQGIVREIRQTRDSQPLEYSRTSPTEWKSSSQRRGIYPASTQLDRNSLSEQQQQQREDEDDYEAAYWASMRSFYEKNPSCSRPWPPKPKNAITIALSSCALFNMVDGRKIYEQEGLEKYMEYQLTNENVILTPGPAFRFVKALQYINARLRDLYPDEQDLFDIVLMTNNHAQVGVRLINSVNHYGLLIDRFCLTGGKDPIGYLKAYLTNLYIAADSEKVQEAIQEGIASATMFDGAKDMAYCDTQLRVAFDGDAVLFSDESEHFTKEHGLDKFFQYDTLCESKPLAQGPLKGFLEDLGRLQKKFYAKNERLLCPIRTYLVTARSAASSGARVLKTLRRWGLEIDEALFLAGAPKSPILVKIRPHIFFDDHMFHIEGAQRLGSIAAYGFNKKFSS

SEQ ID NO: 3638 - protein, 409 aa, Homo sapiens
MAALENGELGPLLSPGTLRGLEDECVTDVKAQTRAALLRVLQEDEEHWGSLEDQPSSLAQDVCELLEEHTERAPRISQEFGERMAHCCLGGLAEFLQSFQQRVERFHENPAVREMLPDTYISKTIALVNCGPPLRALAERLARVGPPESEPAREASASALDHVTRLCHRVVANLLFQELQPHFNKLMRRKWLSSPEALDGIVGTLGAQALALRRMQDEPYQALVAELHRRALVEYVRPLLRGRLRCSSARTRSRVAGRLREDASQLQRLFRRLESQASWLDAVVPHLAEVMQLEDTPSIQVEVGVLVRDYPDIRQKHVAALLDIRGLRNTAARQEILAVARDLELSEEGALSPPRDRAFFADIPVPRPSFCLSLPLFLGRLPLSRLARPSLACLPRPRPPSLARPRAQR

SEQ ID NO: 3639 - protein, 262 aa, Homo sapiens
MEVYIRHLEKVLRRYVQRLQWLLSGSRRLFGTVLESKVCILLDTSGSMGPYLQQVKTELVLLIWEQLRKCCDSFNLLSFAESLQSWQDTLVETTDAACHEAMQWVTHLQAQGSTSILQALLKAFSFHDLEGLYLLTDGKPDTSCSLVLNEVQKLREKRDVKVHTISLNCSDRAAVEFLRKLASFTGGRYHCPVGEDTLSKIHSLLTKGFINEKDPTLPPFEGDDLRILAQEITKARSFLWQAQSFRSQLQKKNDAEPKVTLS

SEQ ID NO: 3640 - protein, 124 aa, Homo sapiens [sequence omitted]

SEQ ID NO: 3641 - protein, 318 aa, Homo sapiens
MTGTFPAYGMSPSLSTITSTSSSITSSIPDTERLDDFHLSIHSDMAAIVKAMASPESGLEVRDRMWLKITIPNAFIGSDVVDWLYHNVEGFTDRREARKYASNLLKAGFIRHTVNKITFSEQCYYIFGDLCGNMANLSLHDHDGSSGASDQDTLAPLPHPGAAPWPMAFPYQYPPPPHPYNPHPGFPELGYSYGGGSASSQHSEGSRSSGSNRSGSDRRKEKDPKAGDSKSGGSGSESDHTTRSSLRSHHTHPSYGPPGVPPLYGPPMLMMPPPPAAMGPPGAPPGRDLASVPPELTASRQSFRMAMGNPSEFFVDVM

SEQ ID NO: 3642 - protein, 531 aa, Homo sapiens [sequence omitted]

SEQ ID NO: 3643 - protein, 160 aa, Homo sapiens
MYENAWMSRQKFAAGAEPSWRTSARAVRKGNVELESPHKVPTGALPNGAVRKGPPSSRPQNGRSTNSLHHAPGRAADTQHQPVKAARSGDVTCKATGVELPKAVGAHLLHQHGLDVRHGVKGDYFAPLRFNACPMDFGLSWGQYPLCFGQFLPFGLGLLG

SEQ ID NO: 3644 - protein, 356 aa, Homo sapiens
MSRLWDSRLRHYLGSRYDARRGVSDWDLRMKLHDRGAQVIHPQEFRRWRDTGVAFELRDSSAYHVPNRTLASGRLLSYRGERVAARGYWGDIATGPFVAFGIEADDESLLRTSNGQPVKTAGEITQHNVTELLRDVAAWGRARATGGDLEEQQHAEGSPEPGTPAAPTPESFTVHFLPLNSAQTLHHKSCYNGRFQLLYVACGMVHLLIPELGACVAPGGNLIVELARYLVDVRQEQLQGFNTRVRELAQAAGFAPQTGARPSETFARFCKSQESALGNTVPAVEPGTPPLDILAQPLEASNPALEGLTQPLQGGTPHCEPCQLPSESPGSLSEVLAQPQGALAPPNCESDSKTGV

SEQ ID NO: 3645 - protein, 368 aa, Homo sapiens
MRVHSGEKPNKCMFEGCSKAFSRLENLKIHLRSHTGEKPYLCQHPGCQKAFSNSSDRAKHQRTHLDTKPYACQIPGCSKRYTDPSSLRKHVKAHSAKEQQVRKKLHAGPDTEADVLTECLVLQQLHTSTQLAASDGKGGCGLGQELLPGVYPGSITPHNGLASGLLPPAHDVPSRHHPLDATTSSHHHLSPLPMAESTRDGLGPGLLSPIVSPLKGLGPPPLPPSSQSHSPGGQPFPTLPSKPSYPPFQSPPPPPLPSPQGYQGSFHSIQSCFPYGDCYRMAEPAAGGDGLVGETHGFNPLRPNGYHSLSTPLPATGYEALAEASCPTALPQQPSEDVVSSGPEDCGFFPNGAFDHCLGHIPSIYTDT

SEQ ID NO: 3646 - protein, 852 aa, Homo sapiens
MSGRARVKARGIARSPSATEVGRIQASPLPRSVDLSNNEASSSNGFLGTSRISTNDKYGISSGDAGSTFMERGVKNKQDFMDLSICTREKLAHVRNCKTGSSGIPVKLVTNLFNLDFPQDWQLYQYHVTYIPDLASRRLRIALLYSHSELSNEAKAFDGAILFLSQKLEEKVTELSSETQRGETIKMTITLKRELPSSSPVCIQVFNIIFRKILKKLSMYQIGRNFYNPSEPMEIPQHKLSLWPGFAISVSYFERKLLFSADVSYKVLRNETVLEFMTALCQRTGLSCFTQTCEKQLIGLIVLTRYNNRTYSIDDIDWSVKPTHTFQKRDGTEITYVDYYKQQYDITVSDLNQPMLVSLLKKKRNDNSEAQLAHLIPELCFLTGLTDQATSDFQLMKAVAEKTRLSPSGRQQRLARLVDNIQRNTNARFELETWGLHFGSQISLTGRIVPSEKILMQDHICQPVSAADWSKDIRTCKILNAQSLNTWLILCSDRTEYVAESFLNCLRRVAGSMGFNVDYPKIIKVQENPAAFVRAIQQYVDPDVQLVMCILPSNQKTYYDSIKKYLSSDCPVPSQCVLARTLNKQGMMMSIATKIAMQMTCKLGGELWAVEIPLKSLMVVGIDVCKDALSKDVMVVGCVASVNPRITRWFSRCILQRTMTDVADCLKVFMTGALNKWYKYNHDLPARIIVYRAGVGDGQLETLIEYEVPQLLSSVAESGSNTSSRLSVIVVRKKCMPRFFTEMNRTVQNPPLGTVVDSEATRNEWYDFYLISQVACRGTVSPTYYNVIYDDNGLKPDHMQRLTFKLCHLYYNWPGIVSVPAPCQYAHKLTFLVAQSIHKEPSLELANHLFYL

SEQ ID NO: 3647 - protein, 696 aa, Homo sapiens
MRRPPPLGPTTASGPEGNVRNHQKRQAPGPGAAGGCGPEAGGRRENKQKRRMVARATPGRGEVESDKSVAASGAGKAARRQVEGRRGQVSPSDSSDPRGLEAAKEAELPLQTERHTKEKRKVTEASSDDPQPGLDLVRKESLTSSESFQTVECLQSLGKESIIEGIKRRIRNKKLKSLENPPLKITENEATQNIKVEFQDELYKNTPKYSCNILSPEVENNSVLKLRDCNCFPHSKGCNDENNLPYKPDGGCMHVAENFSKKENLRSLAEKSDTNSIPQLLQTEENVMGVNKLLPEESDLYQSKTNGLLSCLQHEKNKYSIEESSVGRKPRKRMKLSEKADETVTEMNFSNEYNKSELMLQENQMIADGKEAETKSPLNVLRKVSHNTVSLMDHLLSVPETVEKETSSEHHVNAVFQKTIEPLLKEETENASEPLGYESMASKEDFKSMKSFIGKSPNEYHIERRSSREDLRSASEELKLSCQRTIPMTGKRTWPYYSCARISAWCWKKASLPESSYFLRGSQESCRQVDVPKHQTNQTHLTDSKLLLQSSLTETNTESSSKEKLDSNSNCLSSVSAVEPTLMVIKEPIIKDDKKIKSEELSRRGSEVISNTTEDTQLTSETQSLTGNKKKARGNLTKLNLTATSKDGQEANNSAGKTIHRKACIAQQTFIVPDLVKILNTGRLTNFKIPLLKNKS

SEQ ID NO: 3648 - protein, 284 aa, Homo sapiens
MPHGRPGYSRVSGSGIHPEAAGPAQTLYLGEPQAPLPKSLRVGPGEGEARWAGLTEGVGPGSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 3649 - protein, 530 aa, Homo sapiens [sequence omitted]

SEQ ID NO: 3650 - protein, 439 aa, Homo sapiens [sequence omitted]

SEQ ID NO: 3651 - protein, 380 aa, Homo sapiens [sequence omitted]

SEQ ID NO: 3652 - protein, 102 aa, Homo sapiens
MLLHTLPAMPRPAPQPQCPNTNASQHSRTSSLGRLSPRNTSQLQKAKVWIPLYAWEPPLFRGDMDAGAPHGQKALRSSAPRGQEVLWSSLPSNALRDRTDDC

SEQ ID NO: 3653 - protein, 367 aa, Homo sapiens
MRPSAKSLVCGKHWSDGASQWFASLVSGCTLLVKVFSVVHSVLHVDVYQYSGVQDAINIRDVLIQQGYAELTEESYESKQSHEVLKGLFSKSVENMTDGSVPFPMKDDEKYLIRILLESFSTNKLGTPNCKAELHGPFNPYELKCHSLTRISKFRCVWIEKESINSVIISDAPEDLHQRMLVAASLSINATGSTMLLRETSLMPHIPGLPALLSMLFAPVIELRIDQNGKYYTGVLCGLGWNPATGASILPEHDMELAFDVQFSVEDVVEVNILRAAINKLVCDGPNGCKCLGPERVAQLQDIARQKLLGLFCQSKPREKIVPKWHEKPYEWNQVDPKLVMEQADRESSRGKNTFLYQLHKLVVLGT

SEQ ID NO: 3654 - protein, 318 aa, Homo sapiens
MMGLFFIYGTYLSGTELGGLITVLCFFFNHGEATCVMWTPPLRESFSYPFLVLQMYVLTLILRTSSNDRRPFIALCLSNVAFMLPWQFAQFILFTQIASLFPMYVVGYIEPSKFQKIIYMNMISVTLSFILMFGNSMYLSSYYSSSLLMTWAIILKRNEIQKLGVSKLNCWLIQGSAWWCGTIILKFLTSKILGVSDHICLSDLIAAGILRYTDFDTLKYTCSPEFDFMEKATLLIYTKTLLLPVVMVITCFIFKKTVGDISRVLATNVYLRKQLLEHSELAFHTLQLLAFTALAILILRLKLFLTQHMCVMASLICS

SEQ ID NO: 3655 - protein, 203 aa, Homo sapiens
MSPKLFHLRERHADARTSRTLLLLAKAVQNVGNMDTPASRAKEAWMEPLQPTVRQGVAQLKDFITKLVDIEEKDELDLQRTLSLQAPPVKEGPLFIHRTKGKGPLMSSSFKKLYFSLTTEALSFAKTPSSKEFPFVSGSRATGKSSDIRATKYIWRVLEYLRAWPRGQRRLKSSPHQPPGLLPSRCLPWGQVELLPPKRRDSV

SEQ ID NO: 3656 - protein, 159 aa, Homo sapiens
MQRVGNTFSNESRVASRCPSVGLAERNRVATMPVRLLRDSPAAQEDNDHARDGFQMKLDAHGFAPEELVVQVDGQWLMVTGQQQLDVRDPERVSYRMSQKVHRKMLPSNLSPTAMTCCLTPSGQLWVRGQCVALALPEAQTGPSPRLGSLGSKASNLTR

SEQ ID NO: 3657 - protein, 816 aa, Homo sapiens [sequence omitted]

SEQ ID NO: 3658 - protein, 439 aa, Homo sapiens
MVPSREALLGPGTTAIRCPKKLQNQNYKGHGLSKGKEREQRASIRFKTTLMNTLMDVLRHRPGWVEVKDEGEWDFYWCDVSWLRENFDHTYMDEHVRISHFRNHYELTRKNYMVKNLKRFRKQLEREAGKLEAAKCDFFPKTFEMPCEYHLFVEEFRKNPGITWIMKPVARSQGKGIFLFRRLKDIVDWRKDTRSSDDQKDDIPVENYVAQRYIENPYLIGGRKFDLRVYVLVMSVFAECLLWSGHRRQDVHLTNVAVQKTSPDYHPKKGCKWTLQRFRQYLASKHGPEAVETLFRDIDNIFVKSLQSVQKVIISDKHCFELYGYDILIDQDLKPWLLEVNASPSLTASSQEDYELKTCLLEDTLHVVDMEARLTGREKRVGGFDLMWNDGPVSREEGAPDLSGMGNFVTNTHLGCVNDRKKQLRQLFCSLQVQKKASS

SEQ ID NO: 3659 - protein, 476 aa, Homo sapiens
MVKLIHTLADHGDDVNCCAFSFSLLATCSLDKTIRLYSLRDFTELPHSPLKFHTYAVHCCCFSPSGHILASCSTDGTTVLWNTENGQMLAVMEQPSGSPVRVCQFSPDSTCLASGAADGTVVLWNAQSYKLYRCGSVKDGSLAACAFSPNGSFFVTGSSCGDLTVWDDKMRCLHSEKAHDLGITCCDFSSQPVSDGEQGLQFFRLASCGQDCQVKIWIVSFTHILGFELKYKSTLSGHCAPVLACAFSHDGQMLVSGSVDKSVIVYDTNTENILHTLTQHTRYVTTCAFAPNTLLLATGSMDKTVNIWQFDLETLCQARSTEHQLKQFTEDWSEEDVSTWLCAQDLKDLVGIFKMNNIDGKELLNLTKESLADDLKIESLGLRSKVLRKIEELRTKVKSLSSGIPDEFICPITRELMKDPVIASDGYSYEKEAMENWISKKKRTSPMTNLVLPSAVLTPNRTLKMAINRWLETHQK

SEQ ID NO: 3660 - protein, 246 aa, Homo sapiens
MCYPFRQTYSLSKCLLSQHSVADSVLGRAKCRHTFAKTQGHMCMHTQTCRLTPVFSLLPIPGSSREDRENVTTPNPSHCMLSPVPDTLPPQQHGPGPRVSLQTCPDHIHTHTHTHTHTHTRRGMCLVQIYIKLTHRQIPCLCLLGPDSAVMRVTSATCALLLALICSVQLGDACLDIDKLLANVVFDVSQDLLKEELARYNPSPLTEESFLNVQQCFANVSVTERFAHSVVIKKILQSNDCIEAAF

SEQ ID NO: 3661 - protein, 128 aa, Homo sapiens
MQKILWNGPGEKGRIRDGRDTVSHTVAGILHGGPGQPGSSFAYGSFPPQSNLLEPILLPSNKDAQTPGGSVLLPAPSSSNTPGELHAHRSYLHPLSQALRSNIRHSAGNGAILPSPKSLLFPVEMGEA

SEQ ID NO: 3662 - protein, 195 aa, Homo sapiens
MEHTQASSWAMSVSSSQGLKSSRMEDLATSSGFLAFFSAYCCSRSSCSCAAFLSSSSLSLPNRSVSSSSSSSAGVNGFLARGSTWRMGDMCWVCGAVARWPGEFFSSTFSRASSLEMTCCSSCTTLRRLWFSTFRLVIRTTSSLWSPLGPLEAPGPEFPARDFWMFSLALAMSRRITLASFSWREAPATGPFICS

SEQ ID NO: 3663 - protein, 104 aa, Homo sapiens [sequence omitted]

SEQ ID NO: 3664 - protein, 468 aa, Homo sapiens
MSTADLMENLREELTCFICLDYFSSPVTTECGHSFCLVCLLRSWEEHNTPLSCPECWRTLEGPHFQSNERLGRLASIARQLRSQVLQSEDEQGSYGRMPTTAKALSDDEQGGSAFVAQSHGANRVHLSSEAEEHHREKLQEILNLLRVRRKEAQAVLTHEKERVKLCQEETKTCKQVVVSEYMKMHQFLKEEEQLQLQLLEQEEKENMRKLRNNEIKLTQQIRSLSKMIAQIESSSQSSAFESLEEVRGALERSEPLLLQCPEATTTELSLCRITGMKEMLRKFSTEITLDPATANAYLVLSEDLKSVKYGGSRQQLPDNPERFDQSATVLGTQIFTSGRHYWEVEVGNKTEWEVGICKDSVSRKGNLPKPPGDLFSLIGLKIGDDYSLWVSSPLKGQHVREPVCKVGVFLDYESGHIAFYNGTDESLIYSFPQASFQEALRPIFSPCLPNEGTNTDPLTICSLNSHV

SEQ ID NO: 3665 - protein, 522 aa, Homo sapiens [sequence omitted]

SEQ ID NO: 3666 - protein, 636 aa, Homo sapiens
MARADPVPKARPWGEHQHQFRGRANLHVFEDWCGSSIQQLRRNLHFPLYPHIRTTLRKLAVSPKWTNYGLRIFGYLHPFTDGKIQFAIAADDNAEFWLSLDDQVSGLQLLASVGKTGKEWTAPGEFGKFRSQISKPVSLSASHRYYFEVLHKQNEEGTDHVEVAWRRNDPGAKFTIIDSLSLSLFTNETFLQMDEVGHIPQTAASHVDSSNALPRDEQPPADMLRPDPRDTLYRVPLIPKSHLRHVLPDCPYKPSYLVDGLPLQRYQGLRFVHLSFVYPNDYTRLSHMETHNKCFYQENAYYQDRFSFQEYIKIDQPEKQGLEQPAGFEENLLEESQYGEVAEETPASNNQNARMLEGRQTPASTLEQDATDYRLRSLRKLLAQPREGLLAPFSKRNSTASFPGRTSHIPVQQPEKRKQKPSPEPSQDSPHSDKWPPGHPVKNLPQMRGPRPRPAGDSPRKTQWLNQVESYIAEQRRGDRMRPQAPGRGWHGEEEVVAAAGQEGQVEGEEEGEEEEEEEDMSEVFEYVPVFDPVVNWDQTFSARNLDFQALRTDWIDLSCNTSGNLLLPEQEALEVTRVFLKKLNQRSRGSVDFPIPDILCKWNHVMCGLYIGLFAEYSLSTSFIRVVESIKHFIP

SEQ ID NO: 3667 - protein, 107 aa, Homo sapiens [sequence omitted]

SEQ ID NO: 3668 - protein, 137 aa, Homo sapiens
MASPFGRLTDQKGRGHPAGSGGVEVNGGSARAAFSGGGRRVLSGGGRTAFGGGGRTAFGDGGRTAFGVGGRTAFGGGGRTAFGGGGRTAFGVGGRTAFGGGERVSLLSPGWSALARSWLTASSASRVQAILLPQPPE

SEQ ID NO: 3669 - protein, 573 aa, Homo sapiens [sequence omitted]

SEQ ID NO: 3670 - protein, 123 aa, Homo sapiens
MLKAVVLKFHTTCSSSCVLSELPLTVTFHGHVPQQTCDTDFSVVLGHWGKGGRREKRRGEKKRNGSGVHSSISLVIRGPAVPTMVPRKLAWTWRPSSDLVWASKATRPFSCFGHAFSAALPLS

SEQ ID NO: 3671 - protein, 365 aa, Homo sapiens
MRCHTGEKPLHCNKCGMVFTYYSCLARHQRMHTGEKPYKCNVCGKVFIDSGNLSIHRRSHTGEKPFQCNECGKVFSYYSCLARHRKIHTGEKPYKCNDCGKAYTQRSSLTKHLVIHTGENPYHCNEFGEAFIQSSKLARYHRNPTGEKPHKCSECGRTFSHKTSLVYHQRRHTGEMPYKCIECGKVFNSTTTLARHRRIHTGEKPYKCNECGKVFRYRSGLARHWSIHTGEKPYKCNECGKAFRVRSILLNHQMMHTGEKPYKCNECGKAFIERSNLVYHQRNHTGEKPYKCMECGKAFGRRSCPTKHQRIHSSEKPYKCNECGKSYISRSGLTKHQIKHAGENLTTKLNVERPLDVVLTSGIPK

SEQ ID NO: 3672 - protein, 445 aa, Homo sapiens
MTRTQKGKTFLPHCFYQSLPPRLGWGMILNYSKLKGKEECASVSSVPMVFFSSQYRLHRKSQYLKMAAANLTFSQEVVWQRGLPSIPYSQYSFDHLYNTNDIIHTPQIRKARPQKPVSFKFLGSSSPLTGDTSLAVKTESSANPEKKLKKSKPASTVREAPRPLIHHPCMHPDMLGRPPSLDVNLEEREAWLLPPEKEARAWEATVLEKLNERTARWIQSKRPRRPGASPNKWQSFLRQQYDWSHIRDELTSASDLELLKQLEAEETAEFEDQSVILPPQEKKKPELLLPVYYRLPSYFQQAETVEIMPGNKSTEDIHEKTSLSQPQTQSYFRQVTPRAGKFAYSTDNTFEQEIYFDEVQIIHQIGAKRDQIVLENLNRYNKQLSKVFPETPEKWSAQAIPEASYRPVQGALRWTALPTPAKDMLLQVGEKDVPIKTRCTAGSLP

SEQ ID NO: 3673 - protein, 175 aa, Homo sapiens [sequence omitted]

SEQ ID NO: 3674 - protein, 158 aa, Homo sapiens
MALEVLMLLAVLIWTGAENLHVKISCSLDWLMASVIPVAESRNLYIFADELHLGMGCPANRIHTYVYEFIYLVRDCGIRTRVVSEETLLFQTELYFTPRNIDHDPQEIHLECSTSRKSVWLTPVSTENEIKLDPSPFIADFQTTAEELGLLSSSPNLL

SEQ ID NO: 3675 - protein, 428 aa, Homo sapiens
MILHSQDKPFKCTYCEEHFKSRFARLKHQEKFHLGPFPCDICGRQFNDTGNLKRHIECTHGGKRKWTCFICGKSVRERTTLKEHLRIHSGEKPHLCSICGQSFRHGSSYRLHLRVHHDDKRYECDECGKTFIRHDHLTKHKKIHSGEKAHQCEECGKCFGRRDHLTVHYKSVHLGEKVWQKYKATFHQCDVCKKIFKGKSSLEMHFRTHSGEKPYKCQICNQSFRIKKTLTKHLVIHSDARPFNCQHCNATFKRKDKLKYHIDHVHEIKSPDDPLSTSEEKLVSLPVEYSSDDKIFQTETKQYMDQPKVYQSEAKTMLQNVSAEVCVPVTLVPVQMPDTPSDLVRHTTTLPPSSHEILSPQPQSTDYPRAADLAFLEKYTLTPQPANIVHPVRPEQMLDPREQSYLGTLLGLDSTTGVQNISTNEHHS

SEQ ID NO: 3676 - protein, 103 aa, Homo sapiens [sequence omitted]

SEQ ID NO: 3677 - protein, 154 aa, Homo sapiens
MAAASAMAEASSETTSEEGQSIQEPKEANSTKAQKQKRRGCRGSRRRHANRRGDSFGDSFTPYFPRVLKQVHQGLSLSQEAVSVMDSMIHDILDRIATEAGQLAHYTKRVTITSRDIQMAVRLLLPGKMGKLAEAQGTNAALRTSLCAIWQQRK

SEQ ID NO: 3678 - protein, 218 aa, Homo sapiens
MRLQAHVLGQLKPVCYVAPSLCDTHVGCLSASDKLARWAVLGLGGALLAHLVSPLYSTSLILADSCHDPPTLSRAIHTRPCLDSVLGPCLPPPYVRTALHLFAGPPVAPSEPTPDTCRGLSLNWSLGDPGIEVVDVATGRVKANAALGPPSRLCKASFLRAFHQAARAVGKPYLLALKTYEAAKAGPYQEARRQLSLLLDQQGLGAWPSKPLVGKFRN

SEQ ID NO: 3679 - protein, 200 aa, Homo sapiens [sequence omitted]

SEQ ID NO: 3680 - protein, 619 aa, Homo sapiens
MDDDDDSCLLDLIGDPQALNYFLHGPSNKSSNDDLTNAGYSAANSNSIFANSSNADPKSSLKGVSNQLGEGPSDGLPLSSSLQFLEDELESSPLPDLTEDQPFDILQKSLQEANITEQTLAEEAYLDASIGSSQQFAQAQLHPSSSASFTQASNVSNYSGQTLQPIGVTHVPVGASFASNTVGVQHGFMQHVGISVPSQHLSNSSQISGSGQIQLIGSFGNHPSMMTINNLDGSQIILKGSGQQAPSNVSGGLLVHRQTPNGNSLFGNSSSSPVAQPVTVPFNSTNFQTSLPVHNIIIQRGLAPNSNKVPINIQPKPIQMGQQNTYNVNNLGIQQHHVQQGISFASASSPQGSVVGPHMSVNIVNQQNTRKPVTSQAVSITGGSIVIHSPMGQPHAPQSQFLIPTSLSVSSNSVHHVQTINGQLLQTQPSQLISGQVASEHVMLNRNSSNMLRTNQPYTGPMLNNQNTAVHLVSGQTFAASGSPVIANHASPQLVGGQMPLQQASPTVLHLSPGQSGVSQGRPGFATMPSVTSMSGPSRFPAVSSASTAHPSLGSAVQSGSSGSNFTGDQLTQPNRTPVPVSVSHRLPVSSSKSTSTFSNTPGTGTQQQFFCQVMPFPK

SEQ ID NO: 3681 - protein, 123 aa, Homo sapiens
MLGLEGPCWVGPGPDGGLAVSEEFGDVRLFGSARQPLGSLGGWTGHTFGCPAGICSNSEGNVIVADEQRRQVTLFPRAGPPICLVSEGLGQPLGVACAPQGQLLVADAKDNSIKVYQGLKELA

SEQ ID NO: 3682 - protein, 259 aa, Homo sapiens
MISYVQVQTVTLIPGDGIGPEISAAVMKIFDAAKAPIQWEEQNVTAIQGPGGKWMIPSEAKESMDKNKMGLKGPLKTPIAAGHPSMNLLLRKTFDLYANVRPCVSIEGYKTPYTDVNIVTIRENTEGEYSGIEHVIVDGVVQSIKLITEGASKRIAEFAFEYARNNHRSNVTAVHKANIMRMSDGPFLQKCREVAESCKDIKFNEMYLDTVCLNMVQDPSQFDVLVMPNLYGDILRFMGRLQTLQARTWRIPQPSCSVP

SEQ ID NO: 3683 - protein, 118 aa, Homo sapiens
MEDLQFENWGPVPKSVIVLTTCITALLDTQESHGNANWKGPLPQGSLRRRGSVESKPTFPKSPPTRPLTPSTVRLYVSGIQGNVNFLFIWEIVHGKQIFFSLVHLLIVYNICTSMQNT

SEQ ID NO: 3684 - protein, 140 aa, Homo sapiens; identical to SEQ ID NO: 2270

SEQ ID NO: 3685 - protein, 149 aa, Homo sapiens [sequence omitted]

SEQ ID NO: 3686 - protein, 129 aa, Homo sapiens
MVDLIGEVLLPLLGQEAEACTADDPADHVKVPAHAAVHVVQNHALLGHVVFDDDDAVGAEAALAAPLELGQVLIGEVAWGGQRQGYQGTMQADVGTGWDVLLSPAEPLICAQHFVCTHGLIGSQSREIY

SEQ ID NO: 3687 - protein, 466 aa, Homo sapiens
MSYRPVVSPVMSLTRRCMRSRTSMRTDAVFLILYKELYYRHIYAKVSGGPSLEQRFESYYNYCNLFNYILNADGPAPLELPNQWLWDIIDEFIYQFQSFSQYRCKTAKKSEEEIDFLRSNPKIWNVHSVLNVLHSLVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 3688 - protein, 171 aa, Homo sapiens [sequence omitted]

SEQ ID NO: 3689 - protein, 147 aa, Homo sapiens
MSFLFGSRSSKTFKPKKNIPEGSHQYELLKHAEATLGSGNLRMAVMLPEGEDLNEWVAVNTVDFFNQINMLYGTITDFCTEESCPVMSAGPKYEYHWADGTNIKKPIKCSAPKYIDYLMTWVQDQLDDETLFPSKIGIINFCKGDPS

SEQ ID NO: 3690 - protein, 104 aa, Homo sapiens
MHPAGRPPALPAVSTQRHRCLLGRSGAGPVCLNVPVEAAWALQDGACSVSAPAGLSVLAELSTYCVCAGHSAESVQTAGWGLPGGGDCFVLRDRQISFKMRARD

SEQ ID NO: 3691 - protein, 133 aa, Homo sapiens [sequence omitted]

SEQ ID NO: 3692 - protein, 156 aa, Homo sapiens [sequence omitted]

SEQ ID NO: 3693 - protein, 392 aa, Homo sapiens [sequence omitted]

SEQ ID NO: 3694 - protein, 243 aa, Homo sapiens
MSSWIARINLAAATHSAPPFPAAVGSQRRFVRPILPVGPAQSSLVRPPGRGGVRRNWECAPGAPGLTRGGWRRAAHLAWEPRRPGGRRARARKAAEGTPGTAPLTARCSQEEQHRSHENCLDAAADDLLDLQRNLPGRRGRGRELEEHRLRKEYLEYEETRYETYVQLLVARLHCPSDALDLWEEQLGREAGGTREPKLSLKKSHSSPSLHQDEAPTTAKVKRNISERRTYRKIIPKRNRNQL

SEQ ID NO: 3695 - protein, 132 aa, Homo sapiens [sequence omitted]

SEQ ID NO: 3696 - protein, 214 aa, Homo sapiens [sequence omitted]

SEQ ID NO: 3697 - protein, 305 aa, Homo sapiens
MTALVLTPVSDTRAYKSALDYTKRSLGIFIDLQKKEKEAHAWLQAGKIYYILRQSELVDLYIQVAQNVALYTGDPNLGLELFEAAGDIFFDGAWEREKAVSFYRDRALPLAVTTGNRKAELRLCNKLVALLATLEEPQEGLEFAHMALALSITLGDRLNERVAYHRLAALQHRLGHGELAEHFYLKALSLCNSPLEFDEETLYYVKVYLVLGDIIFYDLKDPFDAAGYYQLALAAAVDLGNKKAQLKIYTRLATIYHNFLLDREKSLFFYQKARTFATELNVRRVNLPPLPLCGWAPWLAPSHPR

SEQ ID NO: 3698 - protein, 378 aa, Homo sapiens
MTESSMKKLASTLLDAITDKDPLVQEQVCSALCSLGEVRPVETLRACEEYLRQHDKLAHPYRAAVLRAMKRVLSSRASELDKDTASTIILLASSEMTKTKDLVWDWQQAASGVLVAVGRQFISKVMEELLRRLHPGTLPHCAVLHTLASLSVANAFGVVPFLPSVLSSLLPVLGVAKQDTVRVAFCSALQRFSEGALEYLANLDRAPDPTVRKDAFATDIFSAYDVLFHQWLQSREAKLRLAVVEALGPMSHLLPSERLEEQLPKLLPGILALYKKHAETFYLSKSLGQILEAAVSVGSRTLETQLDALLAALHSQVGGGRQGAGPGSAHPSVGSCWTRGAESKLGWMAQPRGAEDWAFPEGHSGDFLAMWRCSCPAQ

SEQ ID NO: 3699 - protein, 117 aa, Homo sapiens
MGSTSGKRGKFKGELKRDCDEGRRAKAMATARGQLSPILDALRQPLWLDLQGLVRTQAHPANPYGEEYSSFLRQLQKCRGSEITRHNPLTGTTVRKLGLGEEELTCPRSRRVEPGLS

SEQ ID NO: 3700 - protein, 139 aa, Homo sapiens [sequence omitted]

SEQ ID NO: 3701 - protein, 133 aa, Homo sapiens
MMEQVKEHYQDLRTQLETKVNYYEREIAALKRNFEKERKDMEQARRREVSVLEGQKADLEELHEKSQEVIWGLQEQLQDTARGPEPEQMGLAPCCTQALCGLALRHHSHLQQIRSSQLLLRFQVWGFLPRTKI

SEQ ID NO: 3702 - protein, 198 aa, Homo sapiens
MLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQVPGCPPTLPNGVLSCGLL

SEQ ID NO: 3703 - protein, 356 aa, Homo sapiens
MTPLALSPPRSTPEPDLSSIPQDAATVPSLAAPQALTVCLYINKQANAGPYLERKKVQQLPEHFGPEQPSAVLQQAVQACIDCAHQQKLVFSLVKQGYGGEMVSVSASFDGKQHLRSLPVVNSIGYVLRFLAKLCRSLLCDDLFSHQPFPRGCSASEKVQEKEEGRMESVKTVTTEEYLVNPVGMNRYSVDTSASTFNHRGSLHPSSSLYCKRQNSGDSHLGGGPAATAGGPRTSPMSSGGPSAPGLRPPASSPKRNTTSLEGNRCASSPSQDAQDARRPRSRNPSAWTVEDVVWFVKDADPQALGPHVELFRKHEIDGNALLLLKSDMVMKYLGLKLGPALKLCYHIDKLKQAKF

SEQ ID NO: 3704 - protein, 492 aa, Homo sapiens [sequence omitted]

SEQ ID NO: 3705 - protein, 151 aa, Homo sapiens [sequence omitted]

SEQ ID NO: 3706 - protein, 461 aa, Homo sapiens [sequence omitted]

SEQ ID NO: 3707 - protein, 129 aa, Homo sapiens [sequence omitted]

SEQ ID NO: 3708 - protein, 303 aa, Homo sapiens
MSEARGEPGSGPEAGARFFCTAGRGLEPFVMREVRARLAATQVEYISGKVFFTTCSDLNMLKKLKSAERLFLLIKKQFPLIISSVSKGKIFNEMQRLINEDPGSWLNAISIWKNLLELDAKKEKLSQRDDNQLKRKVGENEIIAKKLKIEQMQKIEENRDCQLEKQIKEETLEQRDFTTKSEKFQEEEFQNDIEKAIDTHNQNDLTFRVSCRCSGTIGKAFTAQEVGKVIGIAIMKHFGWKADLRNPQLEIFIHLNDIYSVVGIPVFRVSLASRAYIKTAGLRSTIAWAMASLADIKVPYGSD

SEQ ID NO: 3709 - protein, 329 aa, Homo sapiens
MMAPVVLTCHSTGIPAPTVSWSKAGAQLGARGSGYRVSPSGALEIGQALPIHAGRYTCSARNSAGVAHKHVFLTVQASPVVKPLPSVVRAVAEEEVLLPCEASGIPRPTITWQKEGLNVATGVSTQVLPGGQLRIAHASPEDAGNYLCIAKNSAGSAMGKTRLVVQVPPVIENGLPDLSTTEGSHAFLPCKARGSPEPNITWDKDGQPVSGAEGKFTIQPSGELLVKNLEGQDAGTYTCTAENAVGRARRRVHLTILVLPVFTTLPGDRSLRLGDRLWLRCAARGSPTPRIGWTVNDRPVTGLGLLGMGGTESQDTGRLRREGRWGDPT

SEQ ID NO: 3710 - protein, 358 aa, Homo sapiens
MQLQQQQQQQISQQPYPQQPPHPFSQQQQQQQQAHPHQFSQQQLQFPQQQLHPPQQLHRPQQQLQPFQQQHALQQQFHQLQQHQLQQQQLAQLQQQHSLLQQQQQQQIQQQQLQRMHQQQQQQQMQSQTAPHLSQTSQALQHQVPPQQPPQQQQQQQPPPSPQQHQLFGHDPAVEIPEEGFLLGCVFAIADYPEQMSDKQLLATWKRIIQAHGGTVDPTFTSRCTHLLCESQVSSAYAQAIRERKRCVTAHWLNTVLKKKKMVPPHRALHFPVAFPPGGKPCSQHIISVTGFVDSDRDDLKLMAYLAGAKYTGYLCRSNTVLICKEPTGLKYEKAKSGGYPVSTPSGLATFFWETLRH

SEQ ID NO: 3711 - protein, 136 aa, Homo sapiens [sequence omitted]

SEQ ID NO: 3712 - protein, 240 aa, Homo sapiens
MDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPSPSTTRMKTRM

SEQ ID NO: 3713 - protein, 203 aa, Homo sapiens [sequence omitted]

SEQ ID NO: 3714 - protein, 159 aa, Homo sapiens [sequence omitted]

SEQ ID NO: 3715 - protein, 308 aa, Homo sapiens
MVGGLPGNVSQHLDFGSSLEQPQGHWIIKTKSKRRHFTDTSARHHEAYEVKNGEKFEKLGKNISVSTQLTTNQTNPSGQISYECGQCGRYFIQMADFHRHEKCHTGEKSFECKECGKYFRYNSLLIRHQIIHTGKKPFKCKECGKGLSSDTALIQHQRIHTGEKPYECKECGKAFSSSSVFLQHQRFHTGEKLYECNECWKTFSCSSSFTVHQRMHTGEKPYECKECGKRLSSNTALTQHQRIHTGEKPFECKECGKAFNQKITLIQHQRVHTGEKPYECKVCGKTFSWCGRFILHQKLHTQKTPVQA

SEQ ID NO: 3716 - protein, 110 aa, Homo sapiens
MLVCRINRFHGLSLYSQTEALKCVAQASKNRSLADFEKALTDYRAELRDDPIISTHLAKLYDNLLEQNLIRVIEPFSRVQVRTLWGLHFWPGILTVATSLPHLSRMGTHF

SEQ ID NO: 3717 - protein, 110 aa, Homo sapiens [sequence omitted]

SEQ ID NO: 3718 - protein, 533 aa, Homo sapiens
MNTADNLELSLFSHLLEILQSPREGPRNAEAAHQAQLIPKLIFLFNEPSLIPSKISTTIGILACQLRGHFSTQDLLRIGLFVVYTLKPSSVNERQICMDGALDPSLPAGSQTSGKTIWLRNQLLEMLLSVISSPQLHLSSESKEEMFLKLGPDWFLLLLQGHLHASTTVLALKLLLYFLASPSLRTRFRDGLCAGSWVERSTEGVDIVMDNLKSQSPLPEQSPCLLPGFRVLNDFLAHHVHIPEVYLIVSTFFLQTPLTELMDGPKDSLDAMLQWLLQRHHQEEVLQAGLCTEGALLLLEMLKATMSQPLAGSEDGAWAQTFPASVLQFLSLVHRTYPQDPAWRAPEFLQTLAIAAFPLGAQKGVGAESTRNTSSPEAAAEGDSTVEGLQAPTKAHPARRKLREFTQLLLRELLLGASSPKQWLPLEVLLEASPDHATSQQKRDFQSEVLLSAMELFHMTSGGDAAMFRDGKEPQPSAEAAAAPSLANISCFTQKLVEKLYSGMFSADPRHILLFILEHIMVISAPLQARDFS

SEQ ID NO: 3719 - protein, 251 aa, Homo sapiens
MLWFGQPGPGGWNRKCLRPFTLPRGQHPQPSYGFPQVNEVVFSPGESHCATCSEDGSVRVWALASMELVIQFQVLNQSCLCLAWSPPCCGRPEQQRLAAGYGDGSLRIFSVSRTAMELKMHPHPVALTTVAFSTDGQTVLSGDKDGLVAVSHPCTGTTFRVLSDHQGAPISTICVTCKECEDLGVEGTDLWLAASGDQRVSVWASDWLRNHCELVDWLSFPMPATTEVNHAPGTVGGAGTHPPHRSMLRLC

SEQ ID NO: 3720 - protein, 104 aa, Homo sapiens [sequence omitted]

SEQ ID NO: 3721 - protein, 109 aa, Homo sapiens
MLPALEHQTPSSSVLRLGLALLAPQACRQPIVGPCDHVLAPLTNECLSSQKINNESSRQRGRKMDLARDGEERTQKDEVVQIGSWIGGQTKGEAAEVDVKDGEKWTAET

SEQ ID NO: 3722 - protein, 142 aa, Homo sapiens [sequence omitted]

SEQ ID NO: 3723 - protein, 170 aa, Homo sapiens
MWEGNAAEGGFVTEGGKSEGMKLWPLVIFLSYFPGKPGELTLFSVLPELSQSLGLREQELQVVRASGKESSGLVLLSSCPQTASRLQKYFTHARRAQRPTATYCAVTDGIPAASEGKIQAALKLEHIDGVNLVSPGLGRGGVLLDIVPLQRGVRGMDLGWLALLSPKTGK

SEQ ID NO: 3724 - protein, 162 aa, Homo sapiens [sequence omitted]

SEQ ID NO: 3725 - protein, 116 aa, Homo sapiens
MFPFPRSPYFLSIPPLNSHLLSVLLSPCTPAPPPPMAPRCAVCGSWILGTPHRWPLRLPRRRASGLLGVWDRCPDRSRGSLDQGLGASAESPGPYWPAAGWGGSSAEESSFGTEGM

SEQ ID NO: 3726 - protein, 186 aa, Homo sapiens
MSYGRPPPDVEGMTSLKVDNLTYRTSPDTLRRVFEKYGRVGDVYIPRDRYTKESRGFAFVRFHDKRDAEDAMDAMDGAVPGLAADLATAARSLGPALVLDLGRPPSPDPHEGPSPSPRRSPDLVRGPGPGLGPGVLPQCPRGNPNPGRDRRVPPSLLKRKERCPLKKMVMSGNPRHITLIHKWDLG

SEQ ID NO: 3727 - protein, 491 aa, Homo sapiens [sequence omitted]

SEQ ID NO: 3728 - protein, 107 aa, Homo sapiens [sequence omitted]

SEQ ID NO: 3729 - protein, 127 aa, Homo sapiens
MRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILR

SEQ ID NO: 3730 - protein, 470 aa, Homo sapiens [sequence omitted]

SEQ ID NO: 3731 - protein, 133 aa, Homo sapiens
MACGQPHGHTHLVCLLYPLLNSTQPIPLPRTCLAAPTSHPCFGRERSPAIVCVTQSSPRAGLYSTSFHRDPSGPAKPSLPPHPALPTSLLCLVCFMGVTWCISYYILLLSCLSRASGPLHKGWVLSLWLTAVS

SEQ ID NO: 3732 - protein, 104 aa, Homo sapiens
MPAFTPLGLAGSHCIHSLAETGWIRRLRRSAEALELEMWAATGMLTSVTQFVKALSMVYLTCRLILCQANPDTCNQARLHLSPRLSRHTQLSPQSTPWLSWVSF

SEQ ID NO: 3733 - protein, 113 aa, Homo sapiens
MGGHGALICALKNPGKYKSVSAFAPICNPVLCPWGKKAFSGYLGTDQSKWKAYDATHLVKSYPGSQLDILIDQGKDDQFLLDGQLLPDNFIAACTEKKIPVVFRLQEASIRKL

SEQ ID NO: 3734 - protein, 146 aa, Homo sapiens [sequence omitted]

SEQ ID NO: 3735 - protein, 168 aa, Homo sapiens
MKKFFTVAILAGSVLSTAHGSLLNLKAMVEAVTGRSAILSFVGYGCYCGLGGRGQPKDEVDWCCHAHDCCYQELFDQGCHPYVDHYDHTIENNTEIVCSDLNKTECDKQTCMCDKNMVLCLMNQTYREEYRGFLNVYCQGPTPNCSIYGPPPEEVTCSHQSPAPPAPP

SEQ ID NO: 3736 - protein, 107 aa, Homo sapiens
MLFIVQTKIVSSYRVLACVFLQVPMTQGSQGLPQQSYQQPIMLPNQAGQGSLPATGMPVYCNVTPPTPQNNLRLIGPHCPSSTVPVMSASCRTNCASMSNAGWQVKF

SEQ ID NO: 3737 - protein, 136 aa, Homo sapiens [sequence omitted]

SEQ ID NO: 3738 - protein, 118 aa, Homo sapiens
MKKISSSLVIREMQIKTTMRYHLMPVRMAIIKKSGNNTCWRGCGEIGTLLHCWWECKLVQPLWKTVWRFLKDLESEIPFDLAIPLLCIYPKDYTSFCYKDTCTCMFIAALFTIAKTWN

SEQ ID NO: 3739 - protein, 605 aa, Homo sapiens
MDTFKLYITTKLPNPAFTPEINAKTSVIDFTVTMKGLENQLLRRVILTEKQELEAERVKLLEDVTFNKRKMKELEDNLLYKLSATKGSLVDDESLIGVLRTTKQTAAEVSEKLHVAAETEIKINAAQEEFRPAATRGSILYFLITEMSMVNIMYQTSLAQFLKLFDQSMARSEKSPLPQKRITNIIEYLTYEVFTYSVRGLYENHKFLFVLLMTLKIDLQRGTVKHREFQALIKGGAALDLKACPPKPYRWILDMTWLNLVELSKLPQFAEIMNQISRNEKGWKSWFDKDAPEEEIIPDGYNDSLDTCHKLLLIRSWCPDRTVFQARKYIADSLEEKYTEPVILNLEKTWEESDTRTPLICFLSMGSDPTNQIDALAKKLKLECRTISMGQGQEVHARKLIQMSMQQGGWVLLQNCHLGLEFMEELLETLITTEASDDSFRVWITTEPHDRFPITLLQTSLKFTNEPPQGVRAGLKRTFAGINQDLLDISNLPMWKPMLYTVAFLHSTVQERRKFGPLGWNIPYEFNSADFSASVQFIQNHLDECDIKKGVSWNTVRYMIGEVQYGGRVTDDFDKRLLNCFARVSQFRKIKFGDTFHCIFQFFCL

SEQ ID NO: 3740 - protein, 272 aa, Homo sapiens
MQSNMTNTVVRTTLRNDLSQEGIIHHLKILSPIYCAFQNDLLTSSGFTLEWGVYTIIEDLHGAGNFVTEMQLFIGDSPIPQNYSVSASDDVRIEVGLYRQKSNLKVVLTECWATPSSNARDPITFSFINNSCPVPNTYTNVIENGNSNKAQFKLRIFSFINDSIVYLHCKLRVCMESPGATCKINCNNFRLLQNSETSATHQMSWGPLIRSEGEPPHAEAGLGAGYVVLIVVAIFVLVAGTATLLIVRYQRMNGRYNFKIQSNNFSYQVFYE

SEQ ID NO: 3741 - protein, 178 aa, Homo sapiens [sequence omitted]

SEQ ID NO: 3742 - protein, 122 aa, Homo sapiens
MAAPGCGAGGQGTNEGPRVPGQGLRLPPGDNGKENLMARFVPLVRSPRGNLEGPLSSYSPSDPPRGSASPHPGLPPQALGGQASPPLLCCSFSQRTASALSTSRPCMCPHLSTPLAQLGPLF

SEQ ID NO: 3743 - protein, 360 aa, Homo sapiens
MSSVEAKIEDKKVQRESKLTSGKLENLRKEKINFLRNKHKIHVQGTDLPDPIATFQQLDQEYKINSRLLQNILDAGFQMPTPIQMQAIPVMLHGRELLASAPTGSGKTLAFSIPILMQLKQPANKGFRALIISPTRELASQIHRELIKISEGTGFRIHMIHKAAVAAKKFGPKSSKKFDILVTTPNRLIYSLKQDPPGIDLASVEWLVVDESDKLFEDGKTGFRDQLASIFLACTSHKVRRAMFSATFAYDVEQWCKLNLDNVISVSIGARNSAVETVEQELLFVGSETGKLLAVRELVKKGFNPPVLVFVQSIERAKELFHELIYEGINVDVIHAERTQQQVKSNIYFETQKNYLILNY

SEQ ID NO: 3744 - protein, 206 aa, Homo sapiens [sequence omitted]

SEQ ID NO: 3745 - protein, 114 aa, Homo sapiens [sequence omitted]

SEQ ID NO: 3746 - protein, 102 aa, Homo sapiens [sequence omitted]

SEQ ID NO: 3747 - protein, 540 aa, Homo sapiens
MESYHKPDQQKLQALKDTANRLRISSIQATTAAGSGHPTSCCSAAEIMAVLFFHTGKYFDKASYRVYCLLGDGELSEGSVWEAMAFASIYKLDNLVAILDINRLGQSDPAPLQHQMDIYQKRCEAFGWHAIIVDGHSVEELCKAFGQAKHQPTAIIAKTFKGRGITGVEDKESWHGKPLPKNMAEQIIQEIYSQIQSKKKILATPPQEDAPSVDIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 3748 - protein, 540 aa, Homo sapiens [sequence omitted]

SEQ ID NO: 3749 - protein, 115 aa, Homo sapiens
MSKKVRRSYSRLETLGSASTSTPGRRSCFGFEGLLGAEDLSGVSPVVCSKLTEVPRVCAKPWAPDMTLPGISPPPEKQKRKKKKMPEILKTELDEWAAAMNAEFEAAEQFDLLVE

SEQ ID NO: 3750 - protein, 101 aa, Homo sapiens [sequence omitted]

SEQ ID NO: 3751 - protein, 224 aa, Homo sapiens
MGWQLIWAKASCTWQDLVVPQRWTQQRHRALETIQNAVECRALNANPSWNTSNVPFAVASACGYWGYARHSRSARSSARPGSPTAKMISPAARLGSHSQKKGAVSPAALPMDRLECSGAISARCNLRLRGSSDSPAATSRIAGISGACHHAQLIFVFLVESAFHHVGQAGFELLTSGDPPTSASQSVGITGVSHRPRPPPSSFLPCLDPRDRIGTPQVPAPTLP

SEQ ID NO: 3752 - protein, 147 aa, Homo sapiens [sequence omitted]

SEQ ID NO: 3753 - protein, 198 aa, Homo sapiens
MQGPLCVSKGLAHNSWLSVNFLPASRFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTGGKRNAFGTYPEKAAAPAPFLPMTVL

SEQ ID NO: 3754 - protein, 102 aa, Homo sapiens
MICLCSHPPQALFGFQYDASDHTMAWLGPNTVPEVKEMILQDPQLQTTQLPQTTQAPDITWGMLKKTTYKAEQILLQTQKPFTPDNLFLALLSGDAKPEYEQ

SEQ ID NO: 3755 - protein, 110 aa, Homo sapiens [sequence omitted]

SEQ ID NO: 3756 - protein, 221 aa, Homo sapiens [sequence omitted]

SEQ ID NO: 3757 - protein, 113 aa, Homo sapiens [sequence omitted]

SEQ ID NO: 3758 - protein, 205 aa, Homo sapiens
MGLTVPATPSLPCSGTEGRGRWWDAVTTWAHLLAGQQWPEQRGLLGSNAPACCPSRKGGSHGLPCPQPSLAAGPWEAGPGRCLRGAVLEGQAGCMMALGWGVTACSYSDSLLGPQLFGDVCYNCSHVIEGDVVSALNKAWCVSCFSCSTCNSKLTLKNKFVEFDMKPVCKRCYEKFPLELKKRLKKLSELTSRKAQPKATDLNSA

SEQ ID NO: 3759 - protein, 110 aa, Homo sapiens [sequence omitted]

SEQ ID NO: 3760 - protein, 107 aa, Homo sapiens [sequence omitted]

SEQ ID NO: 3761 - protein, 543 aa, Homo sapiens [sequence omitted]

SEQ ID NO: 3762 - protein, 103 aa, Homo sapiens
MQNATTHLGRMFVFHGGRHPSVFRVNVCVSALWRGVPRADPLATAPIGAERTCCPDPAAPTGAEQRRTTLVWSPTILGPAQLVTLLRPHPSLSLHLPFSSCVG

SEQ ID NO: 3763 - protein, 102 aa, Homo sapiens
MMYPSTMVVVIHTCSHDFFAFPNGEFGRPIHFLLKSVVKASLLTGPRLQPAERAGPGHGEARMRSLLLMLSRSRGGVYTTLLTLRDEDSKCHSRKTNLATKK

SEQ ID NO: 3764 - protein, 388 aa, Homo sapiens
MVTLQGFVGPWYRNLFRFLLLFSYIIPISLRVNLDMGKAVYGWMMMKDENIPGTVVRTSTIPEELGRLVYLLTDKTGTLTQNEMIFKRLHLGTVSYGADTMDEIQSHVRDSYSQMQSQAGGNNTGSTPLRKAQSSAPKVRKSVSSRIHEAVKAIVLCHNVTPVYESRAGVTEETEFAEADQDFSDENRTYQASSPDEVALVQWTESVGLTLVSRDLTSMQLKTPSGQVLSFCILQQHTGRRTCAIGDGGNDVSMIQAADCGIGIEGKEGKQASLAADFSITQFRHIGRLLMVHGRNSYKRSAALGQFVMHRGLIISTMQVCHHIHHVPSVLLSAGPGREARDGDALPGAVQGPHQGKILVLQNLPHLGFNKYLPRRHPHVWGPGALRV

SEQ ID NO: 3765 - protein, 104 aa, Homo sapiens
MESHCVAQAGVQWCDLGSLQPLPPRFKQFSCLSLPGSWDYRCPAPRLTNFFCISSGDRVSPCWPGWFGTPDLRRSARFGLPQCWGYRHEPPCHQVFLYSSVRTD

SEQ ID NO: 3766 - protein, 137 aa, Homo sapiens
MKKPRHQMFLFYIIIIEGGTIINYVKGHADTPAFEGAGGRTEAAPLGTRLQPGPWLFSQGSVPGGKGSGPDSAVSRAHVLTAARRPVVLGWVWRCLWSTLPSPQEREPLLQSTLNMGNNLKSRQASRSGSLCCAGFP

SEQ ID NO: 3767 - protein, 162 aa, Homo sapiens
MPGKLLWGDIMELEAPLEESESQKKERQKFFSPLNPIRVHIDIGADGRATGEADVEFVTHEDAVAAMSKDKNNMQHRYIELFLNSTPGGGSGMGGSGMGGYGRDGMDNQGGYGSVGRMGMGNNYSGGYGTPDGLGGYGRGGGGSGGYYGQGGMSGGGWRGMY

SEQ ID NO: 3768 - protein, 108 aa, Homo sapiens [sequence omitted]

SEQ ID NO: 3769 - protein, 189 aa, Homo sapiens
MKDLYFLCLVRFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 3770 - protein, 190 aa, Homo sapiens [sequence omitted]

SEQ ID NO: 3771 - protein, 663 aa, Homo sapiens
MAGMKTASGDYIDSSWELRVFVGEEDPEAESVTLRVTGESHIGGVLLKIVEQINRKQDWSDHAIWWEQKRQWLLQTHWTLDKYGILADARLFFGPQHRPVILRLPNRRALRLRASFSQPLFQAVAAICRLLSIRHPEELSLLRAPEKKEKKKKEKEPEEELYDLSKVVLAGGVAPALFRGMPAHFSDSAQTEACYHMLSRPQPPPDPLLLQRLPRPSSLSDKTQLHSRWLDSSRCLMQQGIKAGDALWLRFKYYSFFDLDPKTDPVRLTQLYEQARWDLLLEEIDCTEEEMMVFAALQYHINKLSQSGEVGEPAGTDPGLDDLDVALSNLEVKLEGSAPTDVLDSLTTIPELKDHLRIFRPRKLTLKGYRQHWVVFKETTLSYYKSQDEAPGDPIQQLNLKGCEVVPDVNVSGQKFCIKLLVPSPEGMSEIYLRCQDEQQYARWMAGCRLASKGRTMADSSYTSEVQPILAFLSLRRTGSGGPGNHPHGPDASAEGLNPYGLVAPRFQRKFKAKQLTPRILEAHQNVAQLSLAEAQLRFIQAWQSLPDFGISYVMVRFKGSRKDEILGIANNRLIRIDLAVGDVVKTWRFSNMRQWNVNWDIRQVAIEFDEHINVAFSCVSASCRIVHEYIGGYIFLSTRERARGEELDEDLFLQLTGGHEAF

SEQ ID NO: 3772 - protein, 567 aa, Homo sapiens [sequence omitted]

SEQ ID NO: 3773 - protein, 497 aa, Homo sapiens
MEFGLNWVVLAALLRGVQCQVQLVESGGGVVQPGTSLRLSCVVSGFTFTNFPMHWLRQAPGKGLEWVAVFSSDANDEFYVDSVKGRFTISRDIFSNTLYLHMTNLRPEDTAIYFCAREAYFDTSGDYSRAFDFWGQGTLVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 3774 - protein, 736 aa, Homo sapiens [sequence omitted]

SEQ ID NO: 3775 - protein, 470 aa, Homo sapiens [sequence omitted]

SEQ ID NO: 3776 - protein, 263 aa, Homo sapiens [sequence omitted]

SEQ ID NO: 3777 - protein, 232 aa, Homo sapiens
MHCPTQQQVGACPQARITWRCHSPQAPLPDTYRGPYREDHPNPAMAYANEVKRVVSSAQEKGRKIAAFFAESLPSVGGQIIPPAGYFSQVAEHIRKAGGVFVADEIQVGFGRVGKHFWAFQLQGKDFVPDIVTMGKSIGNGHPVACVAATQPVARAFEATGVEYFNTFGGSPVSCAVGLAVLNVLEKEQLQDHATSVGSFLMQLLGQQKNQTSHRRGCQGCWALHWCGSDQR

SEQ ID NO: 3778 - protein, 112 aa, Homo sapiens
MTWEAAGSGLLPSPRPPPPLVRCHPFSQTRRSPRPHCFVSRCLSGTALSEQTESSPVSRDVLSLLGPPSAIYSDIGWVCSPGRQQAFRALPESLVSPLAHTHPSPPTTARPG

SEQ ID NO: 3779 - protein, 571 aa, Homo sapiens [sequence omitted]

SEQ ID NO: 3780 - protein, 110 aa, Homo sapiens [sequence omitted]

SEQ ID NO: 3781 - protein, 229 aa, Homo sapiens
MYPTGALIVNLRPNTFSPARHLTVCIRSFTDSSGANIYLEKTGELRLLVPDGDGRPGRVQCFGLEQGGLFVEATPQQDIGRRTTGFQYELVRRHRASDLHELSAPCRPCSDTEVLLAVCTSDFAVRGSIQQVTHEPERQDSAIHLRVSRLYRQKSRVFEPVPEGDGHWQGRVRTLLECGVRPGHGDFLFTGHMHFGEARLGCAPRFKDFQRMYRDAQERGLNPCEVGTD

SEQ ID NO: 3782 - protein, 107 aa, Homo sapiens [sequence omitted]

SEQ ID NO: 3783 - protein, 587 aa, Homo sapiens
MNSVIQALFMATDFRRQVLSLNLNGCNSLMKKLQHLFAFLAHTQREAYAPRIFFEASRPPWFTPRSQQDCSEYLRFLLDRLHEEEKILKVQASHKPSEILECSETSLQEVASKAAVLTETPRTSDGEKTLIEKMFGGKLRTHIRCLNCRSTSQKVEAFTDLSLAFCPSSSLENMSVQDPASSPSIQDGGLMQASVPGPSEEPVVYNPTTAAFICDSLVNEKTIGSPPNEFYCSENTSVPNESNKILVNKDVPQKPGGETTPSVTDLLNYFLAPEILTGDNQYYCENCASLQNAEKTMQITEEPEYLILTLLRFSYDQKYHVRRKILDNVSLPLVLELPVKRITSFSSLSESWSVDVDFTDLSENLAKKLKPSGTDEASCTKLVPYLLSSVVVHSGISSESGHYYSYARNITSTDSSYQMYHQSEALALASSQSHLLGRDSPSAVFEQDLENKEMSKEWFLFNDSRVTFTSFQSVQKITSRFPKDTAYVLLYKKQHSTNGLSGNNPTSGLWINGDPPLQKELMDAITKDNKLYLQEQELNARARALQAASASCSFRPNGFDDNDPPGSCGPTGGGGGGGFNTVGRLVF

SEQ ID NO: 3784 - protein, 400 aa, Homo sapiens [sequence omitted]

SEQ ID NO: 3785 - protein, 697 aa, Homo sapiens [sequence omitted]

SEQ ID NO: 3786 - protein, 334 aa, Homo sapiens
MTRNRAQMLANQSKQGPPPSEKECAPTPAPVTRAKARGSEEDDAQAQHPRKRRFQRFTQQLQQQLNTSTQQTREVIQQTLAAIVDAIKLDAIEPYHSDRANPYFEYLQIRKKIEEKRKILCCITPQAPQCYAEYVTYTGSYLLDGKPLSKLHIPVVSAGPGRATAFSLWDASGAPSHGFLQPVLSHSWPLTSLDLLPPEETQPHFCCGGKSRKLPSCSADPRSFLQLVRARPRSPDLPLTLGAPRSHSCGAPPSRRSLSPLHSPSTRTASREPPPVSPAPAPPPSPLDPRGFPEPPYLHDESLPPPPPLGFWDSRAAAPLGQLGPRPPASPCST

SEQ ID NO: 3787 - protein, 158 aa, Homo sapiens [sequence omitted]

SEQ ID NO: 3788 - protein, 360 aa, Homo sapiens
MALSLPLGPRLGSEPLNHPPGAPREADIVGCTVCPASGEESTSPEQAQTLGQDSLGPPEHFQGGPRGNEPAAHPPRWSTPSSYEDPAGGKHCEHPISGLEVLEAEQNSLHLCLLGLGRRLQDLEQGLGHWALAQSGMVQLQALQVDLRGAAERVEALLAFGEGLAQRSEPRAWAALEQILRALGAYRDSIFRRLWQLQAQLVSYSLVFEEANTLDQDLEVEGDSDWPGPGGVWGPWAPSSLPTSTELEWDPAGDIGGLGPLGQKTARTLGVPCELCGQRGPQGRGQGLEVRADPLEGPSARHPGDISAHLLARSCPSKEVSVALSPPLSLSLGVSFYLTVSLSRLSLSTSSSPISNSLLS

SEQ ID NO: 3789 - protein, 108 aa, Homo sapiens
MFGSWFGSQWGTCGKDHECPCLRLVSPSEVLLHQSSSSIKTGQTKGHFPNGWVFLVHLMLPTELPPGDGNAPCQESPLDPASSQSQSPCQTGPRVTLEGDRPNLEISC

SEQ ID NO: 3790 - protein, 127 aa, Homo sapiens
MLCVCVCVCVCVCVCVFGERVVAQGLGYRQCGKCEAFLIIIISATVMFLHVSERHCPCLRLEVLSAKVFFSCIVRSIHPLCALSAFERLGCSQAAVLRDLKRDLVSLGAESIYLGTLFQERPCLHFH

SEQ ID NO: 3791 - protein, 152 aa, Homo sapiens
MREKTDLITYVWDFTEKRDSKEQVEGGARDWSEGSELSQLIVHSQLQIRLLVPLSPLFPLVLFFLSQSLALLPGLECSGAISAHSNLRLPGSSDSPASASRVAGIAGTHHHAWLIFCVFSGDGVSLCWPGWSRTPDLVICLPRPPKVVGLQA

SEQ ID NO: 3792 - protein, 205 aa, Homo sapiens
MALGPRCGAIRACRRVLERAFSLRKAHSIKDMENTLQLVRNIIPPLSSTKHKGQDGRIGVVGGCQEYTGAPYFAAISALKVGADLSHVFCASAAAPVIKAYSPELIVHPVLDSPNAVHEVEKWLPRLHALVVGPGLGRDDALLRNVQGILEVSKARDIPVVIDADGLWLVAQQPALIHGYRKAVLTPNHVEFSRLYDAVRPYGQR

SEQ ID NO: 3793 - protein, 104 aa, Homo sapiens [sequence omitted]

SEQ ID NO: 3794 - protein, 482 aa, Homo sapiens [sequence omitted]

SEQ ID NO: 3795 - protein, 310 aa, Homo sapiens [sequence omitted]

SEQ ID NO: 3796 - protein, 164 aa, Homo sapiens
MIGKVEGGDAVLRWSSAFSLPQSPGRSAMEKWGARRVSGPPLPFRLLRPRLPLAESKYGSVCGFCNKGWAGRVSLGMGTASPGSRGGEPPGPPRESLVSLRTQGTHLGLERRNDVDLKAKPMLRTFQNGLLSAPLTGASGFGGPVGQPWGVIGEKLTGLMAGDR

SEQ ID NO: 3797 - protein, 114 aa, Homo sapiens [sequence omitted]

SEQ ID NO: 3798 - protein, 130 aa, Homo sapiens [sequence omitted]

SEQ ID NO: 3799 - protein, 481 aa, Homo sapiens
MALCYSAAWDARVITSAWWVYHHQVSKTAPTGEYLTTGSFMIRGKKNFLPPSYLMMGFSFLFKVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEATAREKDLFRSVKDTDLSRNIPGKVKVSAPNLLNVKRK

SEQ ID NO: 3800 - protein, 401 aa, Homo sapiens
MLSPGVESQLYKLPWVCEGGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 3801 - protein, 177 aa, Homo sapiens [sequence omitted]

SEQ ID NO: 3802 - protein, 238 aa, Homo sapiens
MGARTPRPGAGLRDQQMAPSAAPQAPEAFTLKEKGHLLRLPAAFRKAASQNSSLWAQLSSTQTSDSTDAAAAKTQFLQNMQTASGGPQPRLSAVEVEAEAGRLRKACSLLRLRMREELSAAPMDWMQEYRCLLTLEGLQAMVGQCLHRLQELRAAVAEQPPRPCPVGRPPGASPSCGGRAEPAWSPQLLVYSSTQELQTLAALKLRVAVLDQQIHLEKVLLEEEVGVQQRSAALRTRG

SEQ ID NO: 3803 - protein, 144 aa, Homo sapiens [sequence omitted]

SEQ ID NO: 3804 - protein, 151 aa, Homo sapiens
MGACRRKDKLLTRFLFPVPGRLSQDPEPDQQDPTLGGPARVSQLWLEKRGREGSGGLFGLFRGSSELLTALHLQAAEEVMCYTSLQLRPPQGRIPGPGTPVKYSEVVLDSEPKSQASGPEPELYASVCAQTRRARASFPDQAYANSQPAAS

SEQ ID NO: 3805 - protein, 368 aa, Homo sapiens [sequence omitted]

SEQ ID NO: 3806 - protein, 109 aa, Homo sapiens
MSERHGPSPQSVLLSLWFVLTLTPFLFLTLLSCMEHTAPAPFQSAWQTPGLCRSSSFCVPFRSSLCCRQVIEGEGRPWQPSGKSLDSWPSVAGLQPLGGGNFYLTKKWN

SEQ ID NO: 3807 - protein, 133 aa, Homo sapiens [sequence omitted]

SEQ ID NO: 3808 - protein, 113 aa, Homo sapiens [sequence omitted]

SEQ ID NO: 3809 - protein, 153 aa, Homo sapiens [sequence omitted]

SEQ ID NO: 3810 - protein, 675 aa, Homo sapiens
MGSASLDELLRVDIGTLDLASSRLDSAMAVCFGPAALGHLLVSTSSNRVVVLDAVSGRIIRELPGVHPEPCPSLTLSEDARFLLIAAGRTIKVWDYATQASPGPQVYIGHSEPVQAVAFSPDQQQVLSAGDAVFLWDVLAPTESDQSFPGAPPACKTGPGAGPLEDAASRASELPRQQVPKPCQASPPRLGVCARPPEGGDGARDTRNSGAPRTTYLASCKAFTPARVSCSPHSAKGTCPPPASGGWLRLKAVVGYSGNGRANMVWRPDTGFFAYTCGRLVVVEDLHSGAQQHWSGHSAEISTLALSHSAQVLASASGRSSTTAHCQIRVWDVSGGLCQHLIFPHSTTVLALAFSPDDRLLVTLGDHDGRTLALWGTATYDLVSPTRLPEPVHGVAFNPWDAGELTCVGQGTVTFWLLQQRGADISLQVRREPVPEAVGAGGLTSLCYGAPPLLYCGTSSGQVCVWDTRAGRCFLSWEADDGGIGLLLFSGSRLVSGSSTGRLRLWAVGAVSELRCKGSGARSSSVFMEHELVLDGAVVSASFDDSVDMGVVGTTAGTLWFVSWAEGTSTRLISGHRSKVRDFQPGQRRGSRTWCPPCLPAPSPPAQMIPSPAVTGSQRPPWGSQRGSLGCARPLKAVPVVSAQASRLAGLAGLLKLSFPCYCFAFFCLFVFCFL

SEQ ID NO: 3811 - protein, 118 aa, Homo sapiens
MVRSPPHAPSPSFLSSGRLVPDAGSSPLPCLCRFLLPPPLVADTVPGLRERGGSASDRGGELAPSSGEESSEHPEAPFSDLQRRGTLMGWALRTARQLASRNLQERSACWSRTLQKVA

SEQ ID NO: 3812 - protein, 478 aa, Homo sapiens [sequence omitted]

SEQ ID NO: 3813 - protein, 516 aa, Homo sapiens
MNRAKPTTVRRPSAAAKPSGHPPPGDFIALGSKGQANESKTASTLLKPAPSGLPSERKRDAAAALSSASALTGLTKRPKLSSTPPLSALGRLAEAAVAEKRAISPSIKEPSVVPIEVLPTVLLDEIEAAELEGNDDRIEGVLCGAVKQLKVTRAKPDSTLYLSLMYLAKIKPNIFATEGVIEALCSLLRRDASINFKAKGNSLVSVLACNLLMAAYEEDENWPEIFVKVYIEDSLGERIWVDSPHCKTFVDNIQTAFNTRMPPRSVLLQGEAGRVAGDLGAGSSPHPSLTEEEDSQTELLIAEEKLSPEQEGQLMPRYEELAESVEEYVLDMLRDQLNRRQPIDNVSRNLLRLLTSTCGYKEVRLLAVQKLEMWLQNPKLTRPAQDLLMSVCMNCNTHGSEDMDVISHLIKIRLKPKVLLNHFMLCIRELLSAHKDNLGTTIKLVIFNELSSARNPNNMQVLYTALQHSSELAPKVGPGSLALPSTPEYGALGWRGYVSSPAHSLPNGFHFLFCFK

SEQ ID NO: 3814 - protein, 571 aa, Homo sapiens
MASWGGEKRGGAEGSPKLAVYATRKTRSVRSQEDQWYLGYPGDQWSSGFSYSWWKNSVGSESKHGEGALDQPQHDVRLEDLGELHRAARSGDVPGVEHVLAPGDTGVDKRDRKKSIQQLVPEYKEKQTPESLPQNNNPDWHPTNLTLSDETCQRSKNLKVGDKSPSVSPSMPENQSATKELGQMNLTEREKMDTGVVLLSGNDTLHDLCQSQLPENKESKEEQDLELTSEEEQERLKGCENKQPQKTSQEPEMAKDCDREDIPIYPVLPHVQKSEEMWIEQGKLEWKNQLKLVINELKQRFGEIYEKYKIPACPEEEPLLDNSTRGTDVKDIPFNLTNNIPGCEEEDASEISVSVVFETFPEQKEPSLNNIIHPYYHPYSGSQEHVCQSSSKLHLHENKLDCDNDNKLGIGHIFSTDNNFHNDASTKKARNPEVVTVEMKEDQEFDLQMTKNMNQNSDSGSTNNYKSLKPKLENLSSLPPDSDRTSEVYLHEELQQDMQKFKNEVNTLEEEFLALKKENVQLHKEVEEEMEKHRSNSTELSGTLTDGTTVGNDDDGLNQQIPRKENEEHDR

SEQ ID NO: 3815 - protein, 218 aa, Homo sapiens [sequence omitted]

SEQ ID NO: 3816 - protein, 166 aa, Homo sapiens
MDEQEDLPKDMLEQLLKFVPEKSDIDLLEEHKHELDRMAKADRFLFEMSRINHYQQRLQSLYFKKKFAERVAFGNYMNKGQRGNAYGFKISSLNKIADTKSSIDKNITLLHYLITIVENKYPSVLNLNEELRDIPQAAKVKSWNIRSLSPHSPEISLCLLSASSSQ

SEQ ID NO: 3817 - protein, 105 aa, Homo sapiens
MVANKRAFAGTLPFLKPSDLVRLIHNNENSTGEMCPHDSITSCRVPPTTCGNSRGDLGGDTAKPHQPSFGKLTLSAHHSHSASNHSTSFPGHTGNPCPSHTVSLL

SEQ ID NO: 3818 - protein, 455 aa, Homo sapiens [sequence omitted]

SEQ ID NO: 3819 - protein, 114 aa, Homo sapiens [sequence omitted]

SEQ ID NO: 3820 - protein, 226 aa, Homo sapiens [sequence omitted]

SEQ ID NO: 3821 - protein, 231 aa, Homo sapiens
MIHTGEKPYKCEECGKAFNRSSHLTTHKRIHTGHKPYKCKECGKSFSVFSTLTKHKIIHTDKKPYKCEECGKAFNRSSILSIHKKIHTGEKPYKCEECGKAFKRSSHLAGHKQIHSVQKPYKCEECGKAFSIFSTLTKHKIIHTEEKPYKCEKCGKTFYRFSNLNTHKIIHTGEKPCKCEECGKAFNHSSNLIKHKLIHTGDKPYKCEACGKAFRRSSHLSRHKIIHWNSY

SEQ ID NO: 3822 - protein, 601 aa, Homo sapiens
MPERELWPAGTGSEPVTRVGSCDSMMSSTSTRSGSSDSSYDFLSTEEKECLLFLEETIGSLDTEADSGLSTDESEPATTPRGFRALPITQPTPRGGPEETITQQGRTPRTVTESSSSHPPEPQGLGLRSGSYSLPRNIHIARSQNFRKSTTQASSHNPGEPGRLAPEPEKEQVSQSSQPRQAPASPQEAALDLDVVLIPPPEAFRDTQPEQCREASLPEGPGQQGHTPQLHTPSSSQEREQTPSEAMSQKAKETVSTRYTQPQPPPAGLPQNARAEDAPLSSGEDPNSRLAPLTTPKPRKLPPNIVLKSSRSSFHSDPQHWLSRHTEAAPGDSGLISCSLQEQRKARKEALEKLGLPQDQDEPGLHLSKPTSSIRPKETRAQHLSPAPGLAQPAAPAQASAAIPAAGKALAQAPAPAPGPAQGPLPMKSPAPGNVAASKSMPIPIPKAPRANSALTPPKPESGLTLQESNTPGLRQMNFKSNTLERSGVGLSSYLSTEKDASPKTSTSLGKGSFLDKISPSVLRNSRPRPASLGTGKDFAGIQVGKLADLEQEQSSKRLSYQGQSRDKLPRPPCVSVKISPKGVPNEHRREALKKLGLLKE

SEQ ID NO: 3823 - protein, 117 aa, Homo sapiens
MLSSVLAALIGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQQVRTCMKMS

SEQ ID NO: 3824 - protein, 505 aa, Homo sapiens
MPPTQAESVIRSIIREIGQECAAHGEIVSETLIAFMVKAVVLDPSNGFNMDRTLMKSDVQNLVKLCMTRLLDTKNPSLDTIKMQVYFDMNYTNRVEFLEEHHRVLESRLGSVTREITDNRACAKEELESLYRKIISYVLLRSGLGSPTDIKTVREVTAALQSVFPQAELGTFLTLSKKDKERQLKELTMIVTGIRLFNRDCGKGGEGIDDLPAVLHVAIPATMQHIDYQLETARSQVYRYTAILEKAANDPLMRAELQPYMLKEALYNIRQYEVFLQIILSDIITGAQEVEMMTKQLGAHLEQLKMTIKSKIAVPTSQVFPIFIALSTLWTSLQDETIVVGVLSNLFTHIQPFLGAHELYFPERVMQCHLNGATVKTDVCRMKEHMEDRVNVADFRKLEWLFPETTANFDKLLIQYRGFCAYTFAATDGLLLPGNPAIGILKYKEKYYTFNSKDAAYSFAENPEHYIDIVREKAKKNTELIQLLELHQQFETFIPYSQVSRVNIL

SEQ ID NO: 3825 - protein, 206 aa, Homo sapiens [sequence omitted]

SEQ ID NO: 3826 - protein, 525 aa, Homo sapiens [sequence omitted]

SEQ ID NO: 3827 - protein, 169 aa, Homo sapiens [sequence omitted]

SEQ ID NO: 3828 - protein, 197 aa, Homo sapiens [sequence omitted]

SEQ ID NO: 3829 - protein, 468 aa, Homo sapiens
MWQAGQRHGPGVMVTQAGVCYQGTFQADKTVGPGILLSEDDSLYEGTFTRDLTLMGKGKVTFPNGFTLEGSFGSGAGRGLHTQGVLDTAALPPDPSSTCKRQLGVGAFPVESRWQGVYSPFRDFVCAGCPRDLQEALLGFDVQSSRELRRSQDYLSCERTHPEDSVGSMEDILEELLQHREPKALQLYLRKALSNSLHPLGKLLRTLMLTFQATYAGVGANKHLQELAQEEVKQHAQELWAAYRGLLRVALERKGQALEEDEDTETRDLQVHGLVLPLMLPSFYSELFTLYLLLHEREDSFYSQGIANLSLFPDTQLLEFLDVQKHLWPLKDLTLTSNQRYSLVRDKCFLSATECLQKIMTTVDPREKLEVLERTYGEIEGTVSRVLGREYKLPMDDLLPLLIYVVSRARIQHLGAEIHLIRDMMDPNHTGGLYDFLLTALESCYEHIQKEDMRLHRLPGHWHSRELW

SEQ ID NO: 3830 - protein, 1064 aa, Homo sapiens
MNHDFQALALESRGMGELLPTKKFWEPDDSTKDGQKGIFLGDDEWRETAWGASHHSMSQPIMVQRRSGQGFHGNSEVNAILSPRSESGGLGVSMVEYVLSSSPADKLDSRFRKGNFGTRDAETDGPEKGDQKGKASPFEEDQNRDLKQGDDDDSKINGRGLPNGMDADCKDFNRTPGSRQASPTEVVERLGPNTNPSEGLGPLPNPTANKPLVEEFSNPETQNLDAMEQVGLESLQFDYPGNQVPMDSSGATVGLFDYNSQQQLFQRTNALTVQQLTAAQQQQYALAAAQQPHIAGVFSAGLAPAAFVPNPYIISAAPPGTDPYTAAGLAAAATLAGPAVVPPQYYGVPWGVYPANLFQQQAAAAANNTASQQAASQAQPGQQQVLRAGAGQRPLTPNQGQQGQQAESLAAAAAANPTLAFGQGLATGMPGYQVLAPTAYYDQTGALVVGPGARTGLGAPVRLMAPTPVLISSAAAQAAAAAAAGGTASSLTGSTNGLFRPIGTQPPQQQQQQPSTNLQSNSFYGSSSLTNSSQSSSLFSHGPGQPGSTSLGFGSGNSLGAAIGSALSGFGSSVGSSASSSATRRESLSTSSDLYKRSSSSLAPIGQPFYNSLGFSSSPSPIGMPLPSQTPGHSLTPPPSLSSHGSSSSLHLGGLTNGSGRYISAAPGAEAKYRSASSTSSLFSSSSQLFPPSRLRYNRSDIMPSGRSRLLEDFRNNRFPNLQLRDLIGHIVEFSQDQHGSRFIQQKLERATPAERQMVFNEILQAAYQLMTDVFGNYVIQKFFEFGSLDQKLALATRIRGHVLPLALQMYGCRVIQKALESISSDQQSEMVKELDGHVLKCVKDQNGNHVVQKCIECVQPQSLQFIIDAFKGQVFVLSTHPYGCRVIQRILEHCTAEQTLPILEELHQHTEQLVQDQYGNYVIQHVLEHGRPEDKSKIVSEIRGKVLALSQHKFASNVVEKCVTHASRAERALLIDEVCCQNDGPHSALYTMMKDQYANYVVQKMIDMAEPAQRKIIMHKIRPHITTLRKYTYGKHILAKLEKYYLKNSPDLGPIGGPPNGML

SEQ ID NO: 3831 - protein, 111 aa, Homo sapiens [sequence omitted]

SEQ ID NO: 3832 - protein, 678 aa, Homo sapiens
MNATSSRSHAVFQIYLRQQDKTASINQNVRIAKMSLIDLAGSERASTSGAKGTRFVEGTNINRSLLALGNVINALADSKRKNQHIPYRNSKLTRLLKDSLGGNCQTIMIAAVSPSSVFYDDTYNTLKYANRAKDIKSSLKSNVLNVNNHITQYVKICNEQKAEILLLKEKLKAYEEQKAFTNENDQAKLMISNPQEKEIERFQEILNCLFQNREEIRQEYLKLEMLLKENELKSFYQQQCHKQIEMMCSEDKVEKATGKRDHRLAMLKTRRSYLEKRREEELKQFDENTNWLHRVEKEMGLLSQNGHIPKELKKDLHCHHLHLQNKDLKAQIRHMMDLACLQEQQHRQTEAVLNALLPTLRKQYCTLKEAGLSNAAFESDFKEIEHLVERKKVVVWADQTAEQPKQNDLPGISVLMTFPQLGPVQPIPCCSSSGGTNLVKIPTEKRTRRKLMPSPLKGQHTLKSPPSQSVQLNDSLSKELQPIVYTPEDCRKAFQNPSTVTLMKPSSFTTSFQAVSSNINSDNCLKMLCEVAIPHNRRKECGQEDLDSTFTICEDIKSSKCKLPEQESLPNDNKDILQRLDPSSFSTKHSMPVPSMVPSYMAMTTAAKRKRKLTSSTSNSSLTADVNSGFAKRVRQDNSSEKHLQENKPTMEHKRNICKINPSMVRKFGRNISKGNLR

SEQ ID NO: 3833 - protein, 193 aa, Homo sapiens [sequence omitted]

SEQ ID NO: 3834 - protein, 108 aa, Homo sapiens
MQETRPGSCGCHLSKRQTMVTQGGKYTPRPGHLSSSAPDMRLTQKVLGHRVHWCQLRLQTGENPSMCLKTVRCQESCSLSPELYKLEISAKKQAGSAPLTAHVSVLPN

SEQ ID NO: 3835 - protein, 106 aa, Homo sapiens [sequence omitted]

SEQ ID NO: 3836 - protein, 103 aa, Homo sapiens [sequence omitted]

SEQ ID NO: 3837 - protein, 486 aa, Homo sapiens
MISPSPSQEELQTTLEETDQSTQEPFTTKIPRTTELAKTTQAPHRFYTTVRPRTSDKPHIRPVLNRTTTRPTRPKPSGMPSGNGVGTGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 3838 - protein, 118 aa, Homo sapiens; identical to SEQ ID NO: 3001

SEQ ID NO: 3839 - protein, 279 aa, Homo sapiens
MWDHHTHENGYNPHCIFLFFLKNIGFDSTVLLDFLILSETCFLEYFVRYLKLLQKDWDNFFTICNNFDATKSKYDISICGCVPSLVQDQSSNQTIPHRLTAPHSHRDVCARHSWASDAPSEPLKAVMSKGAHTMCASSLSSPRASQSLVDYDSSDDSDVESTDQCLANSKQTSLHQQATKEIQDAAGTSRDKKEFSLEPPSSPLVLKEFDTAFSFDCEVAPNDVVSEVGIFYRIVKCFQELQDAICRLQKKNLFPYNPTALLKLLKYIEVISNKTMNTL

SEQ ID NO: 3840 - protein, 115 aa, Homo sapiens
MAPSLLLLAPLCSLEAVLSSPLEKQCQLPGIFCQLQLPCPLLLSAQLLKGIVYPRCPASPPSPSSPCSKLAGQGSCGGRCSSVWTTSERTSYAGGMLISLSLKVDNPMNKTFANA

SEQ ID NO: 3841 - protein, 490 aa, Homo sapiens
MATEFIKSCCGGCFYGETEKHNFSVERDFKAAVPNSQNATISVPPLTSVSVKPQLGCTEDYLLSKLPSDGKEVPFVVPKFKLSYIQPRTQETPSHLEELEGSARASFGDRKVELSSSSQHGPSYDVYNPFYMYQHISPDLSRRFPPRSEVTRLYGSVCDLRTNKLPGSPGLSKSMFDLTNSSQRFIQRHDSLSSVPSSSSSRKNSQGSNRSLDTITLSGDERDFGRLNVKLFYNSSVEQIWITVLQCRDLSWPSSYGDTPTVSIKGILTLPKPVHFKSSAKEGSNAIEFMETFVFAIKLQNLQTVRLVFKIQTQTPRKKTIGECSMSLRTLSTQEMDYSLDITPPSKISVCHAELELGTCFQAVNSRIQLQILEARYLPSSSTPLTLSFFVKVGMFSSGELIYKKKTRLLKASNGRVKWGETMIFPLIQSEKEIVFLIKLYSRSSVRRKHFVGQIWISEDSNNIEAVNQWKETVINPEKVVIRWHKLNPS

SEQ ID NO: 3842 - protein, 570 aa, Homo sapiens [sequence omitted]

SEQ ID NO: 3843 - protein, 706 aa, Homo sapiens [sequence omitted]

SEQ ID NO: 3844 - protein, 132 aa, Homo sapiens
MLCSQPGLANSSRVRGRVGTIRPVRCPSSSLHMSQRERTWPPPAMSPYWRTWMTITQSWQVSVRVQPRGRAHLLPNPYQQDFLGLPEELRRLSGLSSVGHNWRKRMGTRRGRHEQSPTSRPRKVSSLPPRSC

SEQ ID NO: 3845 - protein, 600 aa, Homo sapiens
MEKEKKKVQDLENRLTKQKEELELKEQKEDVLNNKLSDALAMVEETQKTKATESLKAESLALKLNETLAELETTKTKMIMVEERLILQQKMVKALQDEQESQRHGFEEEIMEYKEQIKQHAQTIVSLEEKLQKVTQHHKKIEGEIATLKDNDPAPKEERPQDPLVAPMTESSAKDMAYEHLIDDLLAAQKEILSQQEVIMKLRKDLTEAHSRMSDLRGELNEKQKMELEQNVVLVQQQSKELSVLKEKMAQMSSLVEKKDRELKALEEALRASQEKHRLQLNTEKEQKPRKKTQTCDTSVQIEPVHTEAFSSSQEQQSFSDLGVRCKGSRHEEVIQRQKKALSELRARIKELEKARSPDHKDHQNESFLDLKNLRMENNVQKILLDAKPDLPTLSRIEILAPQNGLCNARFGSAMEKSGKMDVAEALELSEKLYLDMSKTLGSLMNIKNMSGHVSMKYLSRQEREKVNQLRQRDLDLVFDKITQLKNQLGRKEELLRGYEKDVEQLRRSKVSIEMYQSQVAKLEDDIYKEAEEKALLKEALERMEHQLCQEKRINRAIRQQKVGTRKASLKMDQEREMLRKETSSKSSQSLLHSKPSGKY

SEQ ID NO: 3846 - protein, 186 aa, Homo sapiens [sequence omitted]

SEQ ID NO: 3847 - protein, 346 aa, Homo sapiens
MLAARLVCLRTLPSRVFQPTFITKASPLVKNSITKNQWLVTPSREYATKTRIRTHRGKTGQELKEAALEPSMEKIFKIDQMGRWFVAGGAAVGLGALCYYGLGMSNEIGAIEKAVIWPQYVKDRIHSTYMYLAGSIGLTALSALAVARTPALMNFMMTGSWVTIGATFAAMIGAGMLVHSISYEQSPGPKHLAWMLHSGVMGAVVAPLTILGGPLLLRAAWYTAGIVGGLSTVAMCAPSEKFLNMGAPLGVGLGLVFASSLGSMFLPPTSVAGATLYSVAMYGGLVLFSMFLLYDTQKVIKRAEITPMYGAQKYDPINSMLTIYMDTLNIFMRVATMLATGSNRKK

SEQ ID NO: 3848 - protein, 251 aa, Homo sapiens
MADLTSVLTSVMFSPSSKMFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEQFGKVEDAMLMFDKTTNRHRGFGFVTFENEDVVEKVCEIHFHEINNKMVECKKAQPKEVMFPPGTRGRARGLPYTMDAFMLGMGMLGYPNFVATYGRGYPGFAPSYGYQFPDYLPVSQDIIFIN

SEQ ID NO: 3849 - protein, 391 aa, Homo sapiens [sequence omitted]

SEQ ID NO: 3850 - protein, 276 aa, Homo sapiens
MYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 3851 - protein, 101 aa, Homo sapiens
MLFHGFSAEHYFPVSHFTMISRTPCPQDKSETINPKTCSPKEYLETFIFPVLLPGMASLLHQAKKEKCFEPTAANPTLAPADRRGSSPLHSILLESLCGSL

SEQ ID NO: 3852 - protein, 125 aa, Homo sapiens
MSRFRGCSSSGVRFCSAEREASGSGRGNVLQFVQEPQAQQSRPFPAGAQLSLELLFSDWGMEWAQPRLPKPALPLPVVVAFSRAADCAVDHHFRFCLLLRLLRQLLTLLRDEEREVNPWQRKIVV

SEQ ID NO: 3853 - protein, 121 aa, Homo sapiens
MYGFMDVVCIGLIIHEGSSVYRIFKRWQAVNQQWKVLNYDKTKDIGGDAGGGTAGKSGPRNSRTGPTSGATSRPPAAQRMRTLLPQRCGYTILHLLGQLRPPDARSSSHSGREVVMRVTTV

SEQ ID NO: 3854 - protein, 117 aa, Homo sapiens
MHIGHTDLSSKETKGFHLCPPPSHFLLIPWSSLPGLLFLVPRARCQRPWTSQLGVLETQGQERVMMAAWSQAPARSFCTDCGSWRQRTRHLPRPTKTSGRLMSAVWTRLPTMWYRRC

SEQ ID NO: 3855 - protein, 938 aa, Homo sapiens [sequence omitted]

SEQ ID NO: 3856 - protein, 440 aa, Homo sapiens
MKMHFCIPVSQQRSDALGGRYVLYSVHLDGFLFCRVRYSQLHGWNEQLRRVFGNCLPPFPPKYYLAMTTAMAHERRDQLEQYLQNVTMDPNVLRSDVFVEFLKLAQLNTFDIATKKAYLDIFLPNEQSIRIEIITSDTAERVLEVVSHKIGLCRELLGYFGLFLIRFGKEGKLPVVKKLADFELPYVSLGSSEVENCKVGLRKWYMAPSLDSVLMDCRVAVDLLYMQAIQDIEKGWAKPTQAQRQKLEAFQKEDSQTKFLELAREVRHYGYLQLDPCTCDYPESGSGAVLSVGNNEISCCITLPDSQTQDIVFQMSRVKCWQVTFLGTLLDTDGPQRALNQNLELRFQYSEDSCWQWFVIYTKQAFLLSSCLKKMISEKMVKLAAENTEMQIEVPEQSKSKKYHIQQSQQKDYSSFLSRKSKIKIAKDDCVFGNIKEEDL

SEQ ID NO: 3857 - protein, 116 aa, Homo sapiens [sequence omitted]

SEQ ID NO: 3858 - protein, 259 aa, Homo sapiens [sequence omitted]

SEQ ID NO: 3859 - protein, 247 aa, Homo sapiens
MTSDCSSTHCSPESCGTASGCAPASSCSVETACLPGACATSRCQTPSFLSRSRGLTGCLLPCYFTGSCNSPCLVGNCAWCEDGVFTSNEKETMQFLNDRLANYLEKVRSLEETNAELESRIQEQCEQDIPMVCPDYQRYFNTIEDLQQKILCMKAENSRLAVQLDNCKLATDDFKSKYESELSLRQLLEADISSLHGILEELTLCKSDLEAHVESLKEDLLCLKKNHEETKKLRPFYVVKRDSAQAI

SEQ ID NO: 3860 - protein, 502 aa, Homo sapiens
MAIHLDKQNIILKNDKDEYLKKTRDGVLPPYQDAKPPSPASIKKTYTTSKFNDAEPAKGNLFIGVEVLPENLHLDESETSEEDHGSLEKEKYEQFLSLEEGTKAHYFFEKVVNAAQTWFSLFGWPEGPHSFSIPETIRRDVYKMQFYSSTSPPQKFSRQNDFSKYNKTIYDVLLHLSGKMPPGINSSQSLPVDNHEKRVIQLHLQHSSLLDFLNAQGGCISHVLPEFLLEPEDYKRWIEIMSSTNTMPVSSCTPKKKCSIVIEMSKFEAWSKRAWTDVFLQIYKVLVLSRVVPYCSNNMPPICVQNTPKVNPCFASSNIYSDSERILLSWMNINYENTRHVIWKNCHKDVIPSERWIVNFDKDLSDGLVFATQLGAYCPFLIESHFINMYTRPKSPEEYLHNCLIIVNTLYEIDFDVEIQVCLRVFPKEMDAGVSGLRKEDMPSVWVVTIRLAVAVARTKRQKKGDIQFACFFVCLFFFIFVVISFSLWSRMHFFLLLPLDI

SEQ ID NO: 3861 - protein, 213 aa, Homo sapiens
MGLQDCEEGLDPESSLVWHSYPPPAPNGCPRGPDTQPLPWSQTLTMHPAPPAAPLPLPTPCSITATAASIGAAGIPQAGLVTMVIVLTSVGLPTDDITLIIAVDWALDRFRTMINVLGDALAAGIMAHICRKDFARDTGTEKLLPCETKPVSLQEIVAAQQNGCVKSVAEASELTLGPTCPHHVPVQVERDEELPAASLNHCTIQISELETNV

SEQ ID NO: 3862 - protein, 180 aa, Homo sapiens
MGFWRLLSLRTRSSWSPADRRPDPEKRQDGGWPARESRRGCVYRRQKSKHGWAVDVQLTSENWCFWRGGTKPHHGEGRRHRRAGCQPATLGGPTRPLHLSGGRWRWDGGRPGRGGRRKPIRVLQVSALGIQWGREGCLSAATFYPRPHVAPSAQLERLEMTITRPGQGVALEARTVDFRP

SEQ ID NO: 3863 - protein, 107 aa, Homo sapiens [sequence omitted]

SEQ ID NO: 3864 - protein, 102 aa, Homo sapiens
MPFSCLSLLSKWDYRHLPPCPANFLYFLVETGFHRVSQDGLSLLTSWSAHLGLPNCWDYRREPLRPARCHTLLNDQILCELRARAHLSPRGWPQPFISNLPP

SEQ ID NO: 3865 - protein, 461 aa, Homo sapiens [sequence omitted]

SEQ ID NO: 3866 - protein, 116 aa, Homo sapiens
METGKSEIKLTGGFGSTTKQGKAAYWVNQITDKHPTCEITIQGKKFKGFVDTGADISIISLQHWPSTWPVQPTQFNIVGVGKAPEVYPSSYILPCEGPDEQPGTIQPIITSIPINL

SEQ ID NO: 3867 - protein, 139 aa, Homo sapiens
MDRAWSCFPWKHCWETKPSPAGLPPAAAHARISLLLPLQPRRCTGFIGLKSSCSSLASAPQHRLLPLRGRPAVVLLTTSHDRGPEVTFPLAMNNPIVTPHGCAHRKLLMGRRGTVQAGFSSPYHSAGCVGGQESHYVCK

SEQ ID NO: 3868 - protein, 132 aa, Homo sapiens [sequence omitted]

SEQ ID NO: 3869 - protein, 234 aa, Homo sapiens
MLQTHLGPGENTVSQETSQPPDGQEVISKPQTPLAARPRSISESSASSAKEDEKESSDEADKNSPRNTAQRGKLGDGKEHTKSSGFGWFSWFRSKLTKNASPAGDEDSSDSPDSEETPRASSPHQAGLGLSLTPSPESPPLPDVSAFSRGRGGGEGRGSASSGGAAAGAGVGGLSGPESVSFELCSNPGVLLPPPALKGAVPLYNPSQVPQLPTATSLNRPNRLAQRRYPTQPC

SEQ ID NO: 3870 - protein, 363 aa, Homo sapiens
MVGSCGRCAAAGRLPQRVSGHRAPSSPSAMAVAAVGRPRAVRCPLLLLLSLLLVAGPALGWNDPDRILLRDVKALTLYSDRYTTSRRLDPIPQLKCVGGTAGCEAYTPRVIQCQNKGWDGYDVQWECKTDLDIAYKFGKTVVSCEGYESSEDQYVLRGSCGLEYNLDYTELGLKKLKESGKHQGFSDYYHKLYSSDSCGFITIAVLFVLAFAVYKLFLSDGQGSPPPYSEHPPYSEHSQRFASAAGAPPPGFKSEFTGPQNTGYGASSGFGSAFGGQGYGSSGPGFWSGLGAGGLLGYLFGSNRAATPFSDSWYHPAYPPSHSGAWNSRAYSPLGGGAGSYCASSNADSRTRTASGYGGTRRR

SEQ ID NO: 3871 - protein, 479 aa, Homo sapiens
MVLFFWAWIRQPAGKTLEWIGNIYTSATPSYSPSFMGRVTLSMDAPKRTLFLRLDSVSAADTAIYFCARSQGDTSIDAVQGFDIWGQGTAVVVSAAPTKAPDVFPIISGCRHPKDNSPVVLACLITGYHPTSVTVTWYMGTQSQPQRTFPEIQRRDSYYMTSSQLSTPLQQWRQGEYKCVVQHTASKSKKEIFRWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDHGPMK

SEQ ID NO: 3872 - protein, 504 aa, Homo sapiens [sequence omitted]

SEQ ID NO: 3873 - protein, 331 aa, Homo sapiens
MAKWGQGDPRWIVEEREDGTNVNNWHWTERDATIWSKGKLRGLLVGIAMENEAGRCEISELKQVEGEASCNSRKGKLIFFYEWNIKLAWKGTVKESGAKHKGLIEIPSLSEENEINDTEVNVSKKKGDGEILKDLMRTTGTAKVREALGEYLKALKTEFTTGMILPTKAVATQELTLQRKLNENKLQASPVALGVRIPTVALHLTELFDTTVEQLYSIFTVKELVQKFSKSPAVLEAERGGKFQMFDGNISGEYVELVTNRKIIMKWRCRNWPEEHYATVELNFVPAPGQTELQLDCKGVPVCKEENMKFCWQKQHFEEIKGLLELTAQNA

SEQ ID NO: 3874 - protein, 133 aa, Homo sapiens [sequence omitted]

SEQ ID NO: 3875 - protein, 108 aa, Homo sapiens
MGNFGGPSGIHSTRGPPAARSLGFALHICRPAGLKWVALDGVTEKSCDITERQNRESFPLATPPWPPGLKSAYSSPQLPRPRAAEIPLIPEPSQASASGPTQPLGSGI

SEQ ID NO: 3876 - protein, 255 aa, Homo sapiens
MVEAGKAYVSTSRLFVSGVRDLSQQCQGDTVISECLQRFADSLQEVVNYHMILFDQAQRSVRQQLQSFVKEDVRKFKETKKQFDKVREDLELSLVRNAQAPRHRPHEVEEATGALTLTRKCFRHLALDYVLQINVLQAKKKFEILDSMLSFMHAQSSFFQQGYSLLHQLDPYMKKLAAELDQLVIDSAVEKREMERKHAAIQQRVRPRSRLPAHQAPGRPLRPHPMPGTPSPPLPPACLPPALPTPSLGDQGCSL

SEQ ID NO: 3877 - protein, 391 aa, Homo sapiens [sequence omitted]

SEQ ID NO: 3878 - protein, 104 aa, Homo sapiens [sequence omitted]

SEQ ID NO: 3879 - protein, 121 aa, Homo sapiens
MDTAGQAGGHAASSPEISQPQKGRKPRDLELPLSPSLLGGPGPERTPSLLPTHTLTPVLLTPSSLPPSIHFWSTLSPIAPRSPAKLSFQFPSSGSAQVHIPSISVDGLSTPVVLSPGPQKP

SEQ ID NO: 3880 - protein, 116 aa, Homo sapiens
MREPIFLEPSRSCGLFPWNTPPPTSQCWIQAGEPQVKIFSCCLPGPWLFHCPLSLYQDHRDPMDLMELLHPAWRAGVFGTSLPVEFYALREMLPGYYLIHEACPTICVIFFLRSEL

SEQ ID NO: 3881 - protein, 162 aa, Homo sapiens
MSKRLQAASEIQPGNCPGSSVLPGMEGPLIKPSTPRLPPTLDRDHHYLGLDAGGTTSCPNAVAWPQAPQALGPRHVDKATHHICGWLEAALGPSCDPQPWRSGCPHTWGSVLSHPMPAAPCFWRSSPSPPVSAMSPCHPVQAMPFLGSSCPMPEARPFSWFT

SEQ ID NO: 3882 - protein, 472 aa, Homo sapiens
MSRGGSYPHLLWDVRKRSLGLEDPSRLRSRYLGRREFIQRLKLEATLNVHDGCVNTICWNDTGEYILSGSDDTKLVISNPYSRKVLTTIRSGHRANIFSAKFLPCTNDKQIVSCSGDGVIFYTNVEQDAETNRQCQFTCHYGTTYEIMTVPNDPYTFLSCGEDGTVRWFDTRIKTSCTKEDCKDDILINCRRAATSVAICPPIPYYLAVGCSDSSVRIYDRRMLGTRATGNYAGRGTTGMVARFIPSHLNNKSCRVTSLCYSEDGQEILVSYSSDYIYLFDPKDDTARELKTPSAEERREELRQPPVKRLRLRGDWSDTGPRARPESERERDGEQSPNVSLMQRMSDMLSRWFEEASEVAQSNRGRGRSRPRGGTSQSDISTLPTVPSSPDLEVSETAMEVDTPAEQFLQPSTSSTMSAQAHSTSSPTESPHSTPLLSSPDSEQRQSVEASGHHTHHQSGPLKSWVAGSCSE

SEQ ID NO: 3883 - protein, 123 aa, Homo sapiens
MSPEKELNHLSGGFTDSPHTQGTGGEQSHDRQAGVLTLVGGDEEGTSPALRQPPRPALTGTLCRMSSSAPKSCQGRPRPAGPQEMVQSPGPDKRHWESRSPKEGWNSGKSHVPGCDEGDKMKQ

SEQ ID NO: 3884 - protein, 135 aa, Homo sapiens
MPRNRSCSPGPRAWGMRCTCPARWLRLPPPPDQRDIPPLTPGPVPSRATPRDVVTCRVQVFLVPGTSRLTGSSEVHAEETRQDLPRLRPGRPMRFVIPSDSVGRVGTRRREGIQGAPPVHGCPPVHFLHHSRLHV

SEQ ID NO: 3885 - protein, 420 aa, Homo sapiens
MAELGKKYCVYCLAEVSPLRFRCTECQDIELCPECFSAGAEIGHHRRYHGYQLVDGGRFTLWGPEAEGGWTSREEQLLLDAIEQFGFGNWEDMAAHVGASRTPQEVMEHYVSMYIHGNLGKACIPDTIPNRVTDHTCPSGGPLSPSLTTPLPPLDISVAEQQQLGYMPLRDDYEIEYDQDAETLISGLSVNYDDDDVEIELKRAHVDMYVRKLKERQRRKNIARDYNLVPAFLGKDKKEKEKALKRKITKEEKELRLKLRPLYQFMSCKEFDDLFENMHKEKMLRAKIRELQRYRRNGITKMEESAEYEAARHKREKRKENKNLAGSKRGKEDGKDSEFAAIENLPGFELLSDREKVLCSSLNLSPARYVTVKTIIIKDHLQKRQGIPSKSRLPSYLDKVLKKRILNFLTESGWISRDAS

SEQ ID NO: 3886 - protein, 178 aa, Homo sapiens
MRRVGKWHQDFPVKKRKKLSTWKQELLKLMDRHKKDCAREKPFKCQECGKTFRVSSDLIKHQRIHTEEKPYKCQQCDKRFRWSSDLNKHLTTHQGIKPYKCSWCGKSFSQNTNLHTHQRTHTGEKPFTCHECGKKFSQNSHLIKHRRTHTGEQPYTCSICRRNFSRRSSLLRHQKLHL

SEQ ID NO: 3887 - protein, 122 aa, Homo sapiens
MSFLRWSSSCTKALSGTPAQCFSSPSTSAWWSRLTTSSFWKEALSGRGEPTSSSWRKRGATGPWCRLLQMLQNESLLRPAHSISLPFLLSVVENHSCRVGSCLQDELLEICLECVTSFPSSS

SEQ ID NO: 3888 - protein, 606 aa, Homo sapiens [sequence omitted]

SEQ ID NO: 3889 - protein, 161 aa, Homo sapiens
MGSKAKKRVLLPTRPAPPTVEQILEDVRGAPAEDPVFTILAPEDPPVPFRMMEDAEAPGEQLYQQSRAYVAANQRLQQAGNVPRLPPQADLSGPAGLGSAQGGLHPGFPWGSVGPRLAFTGSQPTWVLTQAPLLMLGLRFIRRLIHAELVGPTQLAPSCVT

SEQ ID NO: 3890 - protein, 120 aa, Homo sapiens
MKRPVSTLPSLTADSAMPLPRSAFEDCDLHQEVLLTPVGKISPSFCLECPVFDLAAGVEPSPRPPGALPLWLSRNRMWLPWPNVVLLSPTPAPQLLSSSGPCVWLVFAGLSLCSGIALPL

SEQ ID NO: 3891 - protein, 266 aa, Homo sapiens [sequence omitted]

SEQ ID NO: 3892 - protein, 614 aa, Homo sapiens [sequence omitted]

SEQ ID NO: 3893 - protein, 157 aa, Homo sapiens
MLSVSRPCFSQGAFLGRTLGSVWAQGGSRLPLCFWYRIRCGRPAVVHIGGEGARWEKGARGRKEHRLRRSDLGSRPVPFLAQGIPDIVIRLLCLSAGSASSHQASDPLSSAAATLAAELDWALVSQKSSEDLAPPSLLLNCISFLITQCPHPRWLPG

SEQ ID NO: 3894 - protein, 431 aa, Homo sapiens
MFAECGFTKDLILFATFNEVKSQNLLVKGLKLSNSYEDFELKKLLFNVIVILCKDLPTVQLLIDGKVILALFTYVKKPEKQKIIDWSAAQHEELQLHAIATLSSVAPLLIEEYVSCQGNARVLAFLEWCESEDPFFSHGNSFHGTGGRGNKFAQMRYSLRLLRAMVYLEDETVNKDLCEKGTIQQMIGIFKNIISKPNEKEEAIVLEIQSDILLILSGLCENHIQRKEIFGTEGVDIVLHVMKTDPRKLQSGLGYNVLLFSTLDSIWCCILGCYPSEDYFLEKEGIFLLLDLLALNQKKFCNLILGIMVEFCDNPKTAAHVNAWQGKKDQTAASLLIKLWRKEEKELGVKRDKNGKIIDTKKPLFTSFQEEQKIIPLPANCPSIAVMDVSENIRAKIYAILGKLDFENLPGLSAEDFVTLCIIHRYLDFKI

SEQ ID NO: 3895 - protein, 407 aa, Homo sapiens [sequence omitted]

SEQ ID NO: 3896 - protein, 152 aa, Homo sapiens
MDARRMKKEEGLTENTGLPRKLLEKHDPWPAYVTYTSQTVKRLIEKSKTRELECMRALEERPWASRQNKPSSVIQPKRRKSSKSSGKAVFRDTLSESTLSMWGAYSVLAMAPTMIPEPTHLHADSRDCPTENYNKIIFARKPMMRMLPTVRY

SEQ ID NO: 3897 - protein, 303 aa, Homo sapiens [sequence omitted]

SEQ ID NO: 3898 - protein, 308 aa, Homo sapiens
MHYGISDDSVKTLSIFIFVIECYSESEQEDPEIAAETPPPPHASQTQSLTAQQASSSSPSLSGTSYSFSSLENTVKTPSSFPSSLSKERQSLPDTVNSLSAAEDEGQPITFAVQVHSPVPSEAGIHKALENSFVTSESGFLNSLSSDDTSSLSSNHDHLTVPDKPAGSKIMDKEETKVSEDDEMEKLYKSLEQASLSPLGDRRPSTKKELRKSFVKRCKNPSINEKLHKIRTLNSTLKCKEHDLAMINQLLDDPKLTARKYREWKVMNTLLIQDIYQQQRASPAPDDTDDTPQELKKSPSSPSVENSI

SEQ ID NO: 3899 - protein, 304 aa, Homo sapiens
MPVTVTRTTITTTTTSSSGLGSPMIVGSPRALTQPLGLLRLLQLVSTCVAFSLVASVGAWTGSMGNWSMFTWCFCFPLSWRNFPITFACYAALFCLSASIIYPTTYVQFLSHGRSRDHAIAATFFSCIACVAYATEVAWTRARPGEITGYMATVPGLLKVLETFVACIIFAFISDPNLYQHQPALEWCVAVYAICFILAAIAILLNLGECTNVLPIPFPSFLSGLALLSVLLYATALVLWPLYQFDEKYGGQPRRSRDVSCSRSHAYYVCAWDRRLAVAILTAINLLAYVADLVHSAHLVFVKV

SEQ ID NO: 3900 - protein, 101 aa, Homo sapiens [sequence omitted]

SEQ ID NO: 3901 - protein, 101 aa, Homo sapiens
MRHDSKCQTLHKKLLLLDSKLLCPLYQWLTRHIGIYAILRGVKCLDSEPEKRELSLKKLETSFYLRDPGRPLGLTGWYNYEGSTGCFLYNFPSPTQLENNL

SEQ ID NO: 3902 - protein, 267 aa, Homo sapiens
MRVAALISGGKDSCYNMMQCIAAGHQIVALANLRPAENQVGSDELDSYMYQTVGHHAIDLYAEAMALPLYRRTIRGRSLDTRQVYTKCEGDEVEDLYELLKLVKEKEEVEGISVGAILSDYQRIRVENVCKRLNLQPLAYLWQRNQEDLLREMISSNIQAMIIKVAALGLDPDKHLGKTLDQMEPYLIELSKKYGVHVCGEGGEYETFTLDCPLFKKKIIVDSSEVVIHSADAFAPVAYLRFLELHLEDKVSSVPDNYRTSNYIYNF

SEQ ID NO: 3903 - protein, 169 aa, Homo sapiens
MLCLLLTLGVALVCGVPAMDIPQTKQDLELPKLAGTWHSMAMATNNISLMATLKAPLRVHITSLLPTPEDNLEIVLHRWENNSCVEKKVLGEKTENPKKFKINYTVANEATLLDTDYDNFLFLCLKDTTTPIQSMMCQYLESWWRTMRSCRDSSGLSGPCPGTYGTCWT

SEQ ID NO: 3904 - protein, 397 aa, Homo sapiens
MGEPRDVLVLPPTPVWKGQEGDLHCLLALMAPLSSAQQGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 3905 - protein, 175 aa, Homo sapiens
MVTTQLVRFGLSNQLVVAFKEDNTVAFKHLFLKGYSGTDEDDYSCSVYTQEDAYESIFFAINQYHQLKDITLGTLGYGENEDNRIGLKVCKQHYKKGTMFPSNETLNIDNDVELDCVQLDLQDLSKKPPDWKNSSFFRLEFYRLLQVEISFHLKGIDLQTIHSRELPDCYVFQNT

SEQ ID NO: 3906 - protein, 115 aa, Homo sapiens [sequence omitted]

SEQ ID NO: 3907 - protein, 572 aa, Homo sapiens
MANDVDKELMKQILCLVNVSHNGVSESELMELYPEMSWTFLTSLIHSLYKMCLLTYGCGLLRFQHLQAWETVRLEYLEGPTVTSSYRQKLINYFTLQLSQDRVTWRSADELPWLFQQQGSKQKLHDCLLNLFVSQNLYKRGHFAELLSYWQFVGKDKSAMATEYFDSLKQYEKNCEGEDNMSCLADLYETLGRFLKDLGLLSQAIVPLQRSLEIRETALDPDHPRVAQSLHQLASVYVQWKKFGNAEQLYKQALEISENAYGADHPYTARELEALATLYQKQNKYEQAEHFRKKSFKIHQKAIKKKGNLYGFALLRRRALQLEELTLGKDTPDNARTLNELGVLYYLQNNLETADQFLKRSLEMRERVLGPDHPDCAQSLNNLAALCNEKKQYDKAEELYERALDIRRRALAPDHPSLAYTVKHLAILYKKMGKLDKAVPLYELAVEIRQKSFGPKHPSVATALVNLAVLYSQMKKHVEALPLYERALKIYEDSLGRMHPRVGETLKNLAVLSYEGGDFEKAAELYKRAMEIKEAETSLLGGKAPSRHSSSGDTFSLKTAHSPNVFLQQGQR

SEQ ID NO: 3908 - protein, 197 aa, Homo sapiens
MSVEYDKFIESGRKWFCHVDDDNYVNARSLLHLLSSFSPSQDVYLGRPSLDHPIEATERVQGGRTVSVGADAIGADAFLDTSPGGTAEGVESWLEKGIGLGAQADPPRWFACGVSGAGQEALTVLGREGVSGPGGEGLEATGQWPAEAPGSFCSKKLLLPGWDLLRGSLRKMPGESHEESGVRSPVLGSSDHHPIFR

SEQ ID NO: 3909 - protein, 169 aa, Homo sapiens
MQCNLERSEDKARWHVSGAWEGGAAVGKAGAWRSPEPPADHAPPPPQLTLLLVLEDRLHRQLTYDLLPSRLGRGLGRRAVTPGGGWAAASCLALRHCLSGQRPGPRLGARALWLPPRGALGGAARPGGGGARGRPRPSVPHASLLPQDDRMKLAAFLESTFLKYRGTQA

SEQ ID NO: 3910 - protein, 145 aa, Homo sapiens
MQYSHCCLQIAPNQEGMVQAGGQGHGLARVVLRAVLSPPCWAPHSPCGSPAATEAGRLMRRLPSVGGRMTAPKTPRFLTRRPPASSPEDPPLPHPKTPRFLTQRPPASLPRRPRFLTLGPVSSHSSGDLRLWTAHQLPQQGGCPG

SEQ ID NO: 3911 - protein, 483 aa, Homo sapiens [sequence omitted]

SEQ ID NO: 3912 - protein, 106 aa, Homo sapiens
MFCCPIQVFYRRGIGFFVFILFFLTWSLALSSRLALSPRLACNGTISACCNLCLPGPSDSPASASLVAGITGICHHAGLIFVFLVETGFCQAGLELTSGDPPVSAS

SEQ ID NO: 3913 - protein, 274 aa, Homo sapiens [sequence omitted]

SEQ ID NO: 3914 - protein, 556 aa, Homo sapiens
MQLVPSIEERETPLTREDRPALQEPPWSLGCTGLKAAMQIQRVVIPVPTLGHRNPWVARDSAVPARDPAWLQEDKVEEEAMAPGLPTACSQEPVTFADVAVVFTPEEWVFLDSTQRSLYRDVMLENYRNLASVADQLCKPNALSYLEERGEQWTTDRGVLSDTCAEPQCQPQEAIPSQDTFTEILSIDVKGEQPQPGEKLYKYNELEKPFNSIEPLFQYQRIHAGEASCECQEIRNSFFQSAHLIVPEKIRSGDKSYACNKCEKSFRYSSDLIRHEKTHTAEKCFDCQECGQAFKYSSNLRRHMRTHTGEKPFECSQCGKTFTRNFNLILHQRNHTGEKPYECKDCGKAFNQPSSLRSHVRTHTGEKPFECSQCGKAFREHSSLKTHLRTHTREKPYECNQCGKPFRTSTHLNVHKRIHTGEKLYECATCGQVLSRLSTLKSHMRTHTGEKPYVCQECGRAFSEPSSLRKHARTHSGKKPYACQECGRAFGQSSHLIVHVRTHSAGRPYQCNQCEKAFRHSSSLTVHKRTHVGRETIRNGSLPLSMSHPYCGPLAN

SEQ ID NO: 3915 - protein, 104 aa, Homo sapiens [sequence omitted]

SEQ ID NO: 3916 - protein, 133 aa, Homo sapiens [sequence omitted]

SEQ ID NO: 3917 - protein, 202 aa, Homo sapiens [sequence omitted]

SEQ ID NO: 3918 - protein, 111 aa, Homo sapiens
MSLPKFEISSPDLCIILLLVLLFFFFLRQRLALSPRLGCSGAISAHCKLRLLGSRHSPASASQVAGTTGARHRSRLIFFVFLVETGFHCVSQDGLDLLTLVLLICMRCMIF

SEQ ID NO: 3919 - protein, 111 aa, Homo sapiens
MSDNEDNFDGDDFDDVEEDEGLDDLENAEEEGQENVEILPSGERPQANQKRITTPYMTKYERARVLGTRALQIAMCAPVMVELEGETDPLLIAMKELNYFQKAFEEAPVQG

SEQ ID NO: 3920 - protein, 208 aa, Homo sapiens [sequence omitted]

SEQ ID NO: 3921 - protein, 254 aa, Homo sapiens
MLSFPLFKDDLCKDDFKTSKGGAHCFPELRVGVFEEIVPMGISPKKISYKKPGIHLSPGEFHKEVEKFLSQANQEQSDTILLDCRNFYESKIGRFQGCLAPDIRKFSYFPSYVDKNLELFREKRVLMYCTGGIRCERGSAYLKAKGVCKEVFQLKGGIHKYLEEFPDGFYKGKLFVFDERYALSYNSDVVSECSYCGARWDQYKLCSTPQWTLFHSAEALAPPPVTLYCPLPYSSVRRPSPFHHQPLCSVLWSS

SEQ ID NO: 3922 - protein, 525 aa, Homo sapiens
MAAGLLGSEDPPWSWNLTCRALRTCQVRNIRVLQLLLKPWCISRAVYQMTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSCIYKELIDVDSEVVFELASYILQEAKGDFSSNEVVRSDLKKLPALPTQALKEHPSLAYCEDRVIEHYKKLNGQTRGQAIVNYMSIVESLPTYGVHYYAVKDKQGIPWWLGLSYKGIFQYDYHDKVKPRKIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGSQESDSSQSAKKDMLAALKSRQEALEETLRQRLEELKKLCLREAELTGKLPVEYPLDPGEEPPIVRRRIGTAFKLDEQKILPKGEEAELERLEREFAIQSQITEAARRLASDPNVSKKL

SEQ ID NO: 3923 - protein, 102 aa, Homo sapiens [sequence omitted]

SEQ ID NO: 3924 - protein, 381 aa, Homo sapiens [sequence omitted]

SEQ ID NO: 3925 - protein, 330 aa, Homo sapiens [sequence omitted]

SEQ ID NO: 3926 - protein, 172 aa, Homo sapiens
MSAWAAASLSRAAARCLLARGPGVRAAPPRDPRPSHPEPRGCGAAPGRTLHFTAAVPAGHNKWSKVRHIKGPKDVERSRIFSKLCLNIRLAVKEGGPNPEHNSNLANILEVCRSKHMPKSTIETALKMEKSKDTYLLYEGRGPGGSSLLIEALSNSSHKCQADIRHILNKNG

SEQ ID NO: 3927 - protein, 225 aa, Homo sapiens
MPKRKAAGQGDMRQEPKRRSARLSAMLVPVTPEVKPKRTSSSRKMKTKSDMMEENIDTSAQAVAETKQEAVVEEDYNENAKNGEAKITEAPASEKEIVEVKEENIEDATEKGGEKKEAVAAEVKNEEEDQKKMKKIKTKRKGKLEKKTKMKKGKKMEKRIKMEMRKEKMQKRKKMEKKVKTEKEMEKMEKRKEKMKKRKKTEKKQGMEKRMKMEKRREIKKRGKM

SEQ ID NO: 3928 - protein, 406 aa, Homo sapiens
MVLEGNPEVGSPRTSDLQHRGNKGSCVLSSPGEDAQPGEEPIKYGELISTPLVSKALSNRGQHSISYTLSRSHSVIVEYTHDSDTDMFQIGRSTENMIDFVVTDTSPGGGAAEGPSAQSTISRYACRILCDRRPPYTARIYAAGFDASSNIFLGERAAKWRTPDGLMDGLTTNGVLVMHPAGGFSEDSAPGVWREISVCGNVYTLRDSRSAQQRGKLVENESNVLQDGSLIDLCGATLLWRTPAGLLRAPTLKQLEAQRQEANAARPQCPVGLSTLAFPSPARGRTAPDKQQPWVYVRCGHVHGYHGWGCRRERGPQERECPLCRLVGPYVPLWLGQEAGLCLDPGPPSHAFAPCGHVCSEKTARYWAQTPLPHGTHAFHAACPFCGAWLTGEHGCVRLIFQGPLD

SEQ ID NO: 3929 - protein, 225 aa, Homo sapiens
MEYWYVALKQQSLKADILPSLFLSIFLVKGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRFGRHRLNPENRTLGSLRNILYLLHQRVRRFGIMGLYKGLEAKLLQTVLTAALMFLVYEKLTAATFTVMGLKRAHQH

SEQ ID NO: 3930 - protein, 108 aa, Homo sapiens
MESCSLAQVGVQWPSLGSLRPPPPGSSDFSASVSRVAGIAGTCHHAWLIFVFLVETGFHHVGRAGLGLLTSGDPPALASQVLGLQAWATAPGPRSFFIAASQGAALCS

SEQ ID NO: 3931 - protein, 217 aa, Homo sapiens
MEQCACVERELDKVLQKFLTYGQHCERSLEELLHYVGQLRAELASAALQGTPLSATLSLVMSQCCRKIKDTVQKLASDHKDIHSSVSRVGKAIDRVSTWPAPGVGWEHPEAGMYKDSKESQQECPHHQALSLLLRQNFDSEICGVVSDAVWDAREQQQQILQMAIVEHLYQQGMLSVAEELCQESTLNVDLDFKQPFLELNRILEALHEQDLGPALE

SEQ ID NO: 3932 - protein, 383 aa, Homo sapiens
MSRAAGRKITRIIGFSKKKTLADDLQTSSTEEEVPCCGYLNVLVNQGWKERWCRLKCNTLYFHKDHMDLRTHVNAIALQGCEVAPGFGPRHPFAFRILRNRQEVAILEASCSEDMGRWLGLLLVEMGSRVTPEALHYDYVDVETLTSIVSAGRNSFLYARSCQNQWPEPRVYDDVPYEKMQDEEPERPTGAQVKRHASSCSEKSHRVDPQVKVKRHASSANQYKYGKNRAEEDARRYLVEKEKLEKEKETIRTELIALRQEKRELKEAIRSSPGAKLKALEEAVATLEAQCRAKEERRIDLELKLVAVKERLQQSLAGGPALGLSVSSKPKSGETANKPQNSVPEQPLPVNCVSELRKRSPSIVASNQGRVLQKAKEWEMKKT

SEQ ID NO: 3933 - protein, 250 aa, Homo sapiens
MPAPAWDQGNRKGGPRVREQLHLLKQQLRHLQEHILQAAKPRDTAQGPGGCGTGKGPLSAKQGNGCGPRPWVVDGDHQQGTSKDLSGAEKHQESEKPSFLPSGAPASLEILRKELTRAVSQAVDSVLQKFNRCITSQMIKWFSNFREFYYIQMEKSARQAISDGVTDPEMLVVLRNSELFQALNMHYNKGNDFEVPDCFLEIASLTLQEFFRAVSAGRDSDPSWKKPIYKIISKLDSDIPEIFKSSSYPQ

SEQ ID NO: 3934 - protein, 123 aa, Homo sapiens
MVLIQELVSIAGTPLLGCSIPTCKAGFSQPVIFDVTPGCGFHCFGRGRYRVVESGQTFCCQLEELICWLYNVADVTDHGTAARSNLTSLKSSLQLYRVICGPGSGLFPHKSVAKLLDYKVKSQ

SEQ ID NO: 3935 - protein, 122 aa, Homo sapiens [sequence omitted]

SEQ ID NO: 3936 - protein, 115 aa, Homo sapiens [sequence omitted]

SEQ ID NO: 3937 - protein, 155 aa, Homo sapiens
MAVPGCNKDSVRAGCKKCGYPGHLTFECRNFLRVDPKRDIVLDVSSTSSEDSDEENEELNKLQALQEKRINEEEEKKKEKSKEKIKLKKKRKRSYSSSSTEEDTSKQKKQKYQKKEKKKEKKSKSKKGKHHKKEKKKRKKEKHSSTPNSSEFSRK

SEQ ID NO: 3938 - protein, 278 aa, Homo sapiens [sequence omitted]

SEQ ID NO: 3939 - protein, 551 aa, Homo sapiens
MDEGVNFKPTEAGRLMAWYYITFETVKKFYTISGKETLSDLVTLIAGCKEFLDIQLRINEKKTLNTLNKDPNRITIRFPMEGRIKTREMKVNCLIQAQLGCIPIQDFALTQDTAKIFRHGSRITRWLSDFVAAQEKKFAVLLNSLILAKCFRCKLWENSLHVSKQLEKIGITLSNAIVNAGLTSFKKIEETDARELELILNRHPPFGTQIKETVMYLPKYELKVEQITRYSDTTAEILVTVILRNFEQLQTKRTASDSHYVTLIIGDADNQVVYLHKITDSVLLKAGSWAKKIAVKRALKSEDLSINLISSEFVGLDIQQKLTVFYLEPKRFGNQITMQRKSETQISHSKHSDISTIAGPNKGTTASKKPGNRECNHLCKSKHTCGHDCCKIGVAQKSEIKESTISSYLSDLRNRNAVSSVPPVKRLKIQMNKSQSVDLKEFGFTPKPSLPSISRSEYLNISELPIMEQWDQPEIYGKVRQEPSEYQDKEVLNVNFELGNEVWDDFDDENLEVTSFSTDTEKTKISVLFHHMRCRIFLYQILLCPSSVHPP

SEQ ID NO: 3940 - protein, 115 aa, Homo sapiens
MSLVRPFPPSCLTGLRFGESVQISPCYPKRGVPRISRARARVRQMRHLGHTFKLVLACRCQESASLGLPPWCLLYLILAPALGLESHQCGPSGIIISLNAWAASAFSSCAPWEAH

SEQ ID NO: 3941 - DNA, 23 bp, Artificial Sequence
  Description of Artificial Sequence: an artificially synthesized primer sequence
gtacatattgtcgttagaacgcg

SEQ ID NO: 3942 - DNA, 27 bp, Artificial Sequence
  Description of Artificial Sequence: an artificially synthesized primer sequence
gatccgcgttctaacgacaatatgtac

SEQ ID NO: 3943 - DNA, 26 bp, Artificial Sequence
  Description of Artificial Sequence: an artificially synthesized primer sequence
gtacatattgtcgttagaacgcgact

SEQ ID NO: 3944 - DNA, 30 bp, Artificial Sequence
  Description of Artificial Sequence: an artificially synthesized primer sequence
gatcagtcgcgttctaacgacaatatgtac

SEQ ID NO: 3945 - DNA, 29 bp, Artificial Sequence
  Description of Artificial Sequence: an artificially synthesized primer sequence
gtacatattgtcgttagaacgcgcatact

SEQ ID NO: 3946 - DNA, 33 bp, Artificial Sequence
  Description of Artificial Sequence: an artificially synthesized primer sequence
gatcagtatgcgcgttctaacgacaatatgtac

SEQ ID NO: 3947 - DNA, 32 bp, Artificial Sequence
  Description of Artificial Sequence: an artificially synthesized primer sequence
gtacatattgtcgttagaacgcgatccatact

SEQ ID NO: 3948 - DNA, 36 bp, Artificial Sequence
  Description of Artificial Sequence: an artificially synthesized primer sequence
gatcagtatggatcgcgttctaacgacaatatgtac

SEQ ID NO: 3949 - DNA, 35 bp, Artificial Sequence
  Description of Artificial Sequence: an artificially synthesized primer sequence
gtacatattgtcgttagaacgcgtcaatccatact

SEQ ID NO: 3950 - DNA, 39 bp, Artificial Sequence
  Description of Artificial Sequence: an artificially synthesized primer sequence
gatcagtatggattgacgcgttctaacgacaatatgtac

SEQ ID NO: 3951 - DNA, 38 bp, Artificial Sequence
  Description of Artificial Sequence: an artificially synthesized primer sequence
gtacatattgtcgttagaacgcgtactcaatccatact

SEQ ID NO: 3952 - DNA, 42 bp, Artificial Sequence
  Description of Artificial Sequence: an artificially synthesized primer sequence
gatcagtatggattgagtacgcgttctaacgacaatatgtac

SEQ ID NO: 3953 - DNA, 22 bp, Artificial Sequence
  Description of Artificial Sequence: an artificially synthesized primer sequence
gtacatattgtcgttagaacgc

SEQ ID NO: 3954 - DNA, 20 bp, Artificial Sequence
  Description of Artificial Sequence: an artificially synthesized primer sequence
ctactcaaggacagccacac

SEQ ID NO: 3955 - DNA, 20 bp, Artificial Sequence
  Description of Artificial Sequence: an artificially synthesized primer sequence
ggatgtagtgggaaacaatg

SEQ ID NO: 3956 - DNA, 20 bp, Artificial Sequence
  Description of Artificial Sequence: an artificially synthesized primer sequence
tgcttttcattctccttagt

SEQ ID NO: 3957 - DNA, 20 bp, Artificial Sequence
  Description of Artificial Sequence: an artificially synthesized primer sequence
tacgtgctcatttacttggt

SEQ ID NO: 3958 - DNA, 20 bp, Artificial Sequence
  Description of Artificial Sequence: an artificially synthesized primer sequence
gccagtttctttatgattga

SEQ ID NO: 3959 - DNA, 20 bp, Artificial Sequence
  Description of Artificial Sequence: an artificially synthesized primer sequence
aatgacttcgttaggatgcc

SEQ ID NO: 3960 - DNA, 20 bp, Artificial Sequence
  Description of Artificial Sequence: an artificially synthesized primer sequence
gctgttgacttcatttggaa

SEQ ID NO: 3961 - DNA, 20 bp, Artificial Sequence
  Description of Artificial Sequence: an artificially synthesized primer sequence
ttggtacttattctgaggca

SEQ ID NO: 3962 - DNA, 20 bp, Artificial Sequence
  Description of Artificial Sequence: an artificially synthesized primer sequence
gattttagtgaaacatgcca

SEQ ID NO: 3963 - DNA, 20 bp, Artificial Sequence
  Description of Artificial Sequence: an artificially synthesized primer sequence
ttaaaactgaggacattctg

SEQ ID NO: 3964 - DNA, 20 bp, Artificial Sequence
  Description of Artificial Sequence: an artificially synthesized primer sequence
agagaaggcagtctagctta

SEQ ID NO: 3965 - DNA, 20 bp, Artificial Sequence
  Description of Artificial Sequence: an artificially synthesized primer sequence
agggtatggtaacttctgca

SEQ ID NO: 3966 - DNA, 20 bp, Artificial Sequence
  Description of Artificial Sequence: an artificially synthesized primer sequence
aaaggagggactagaaaact

SEQ ID NO: 3967 - DNA, 20 bp, Artificial Sequence
  Description of Artificial Sequence: an artificially synthesized primer sequence
actatgacgagggaacaaga

SEQ ID NO: 3968 - DNA, 20 bp, Artificial Sequence
  Description of Artificial Sequence: an artificially synthesized primer sequence
gaggagaacacaagtatggt

SEQ ID NO: 3969 - DNA, 20 bp, Artificial Sequence
  Description of Artificial Sequence: an artificially synthesized primer sequence
aaggtcacttctaaacacac

SEQ ID NO: 3970 - DNA, 20 bp, Artificial Sequence
  Description of Artificial Sequence: an artificially synthesized primer sequence
ggagtgattcaggagatgtg

SEQ ID NO: 3971 - DNA, 20 bp, Artificial Sequence
  Description of Artificial Sequence: an artificially synthesized primer sequence
gcaacagagactttattggt

SEQ ID NO: 3972 - DNA, 20 bp, Artificial Sequence
  Description of Artificial Sequence: an artificially synthesized primer sequence
gagagacttatcacagccat

SEQ ID NO: 3973 - DNA, 20 bp, Artificial Sequence
  Description of Artificial Sequence: an artificially synthesized primer sequence
atgggattctgtgacttctc

SEQ ID NO: 3974 - DNA, 20 bp, Artificial Sequence
  Description of Artificial Sequence: an artificially synthesized primer sequence
cagcaacagtaatgggaatt

SEQ ID NO: 3975 - DNA, 20 bp, Artificial Sequence
  Description of Artificial Sequence: an artificially synthesized primer sequence
aggttaggatttctttagca

SEQ ID NO: 3976 - DNA, 20 bp, Artificial Sequence
  Description of Artificial Sequence: an artificially synthesized primer sequence
tacttggagacaacagggag

SEQ ID NO: 3977 - DNA, 20 bp, Artificial Sequence
  Description of Artificial Sequence: an artificially synthesized primer sequence
gtgtttgtgggcatagacat

SEQ ID NO: 3978 - DNA, 20 bp, Artificial Sequence
  Description of Artificial Sequence: an artificially synthesized primer sequence
aatgtattcagttcctttcc

SEQ ID NO: 3979 - DNA, 20 bp, Artificial Sequence
  Description of Artificial Sequence: an artificially synthesized primer sequence
gtgtcatcactagcaccaag

SEQ ID NO: 3980 - DNA, 20 bp, Artificial Sequence
  Description of Artificial Sequence: an artificially synthesized primer sequence
tggacttagggacctgactc

SEQ ID NO: 3981 - DNA, 20 bp, Artificial Sequence
  Description of Artificial Sequence: an artificially synthesized primer sequence
ctctttacctagtttggtca

SEQ ID NO: 3982 - DNA, 20 bp, Artificial Sequence
  Description of Artificial Sequence: an artificially synthesized primer sequence
tacttattttcacaggggcc

SEQ ID NO: 3983 - DNA, 20 bp, Artificial Sequence
  Description of Artificial Sequence: an artificially synthesized primer sequence
cagcattttcctatatagcc

SEQ ID NO: 3984 - DNA, 20 bp, Artificial Sequence
  Description of Artificial Sequence: an artificially synthesized primer sequence
ccagaagagtagcaagaatt

SEQ ID NO: 3985 - DNA, 20 bp, Artificial Sequence
  Description of Artificial Sequence: an artificially synthesized primer sequence
ctattttaacccctgccctc

SEQ ID NO: 3986 - DNA, 20 bp, Artificial Sequence
  Description of Artificial Sequence: an artificially synthesized primer sequence
ggaggtatctattagggtga

SEQ ID NO: 3987 - DNA, 20 bp, Artificial Sequence
  Description of Artificial Sequence: an artificially synthesized primer sequence
gactgagatgaactggaaga

SEQ ID NO: 3988 - DNA, 20 bp, Artificial Sequence
  Description of Artificial Sequence: an artificially synthesized primer sequence
tcacaatacagtcccctagt

SEQ ID NO: 3989 - DNA, 20 bp, Artificial Sequence
  Description of Artificial Sequence: an artificially synthesized primer sequence
atttgtatcactttggtgca

SEQ ID NO: 3990 - DNA, 20 bp, Artificial Sequence
  Description of Artificial Sequence: an artificially synthesized primer sequence
ctccagaaaatgcatgaatc

SEQ ID NO: 3991 - DNA, 20 bp, Artificial Sequence
  Description of Artificial Sequence: an artificially synthesized primer sequence
cttcaacagtgcttttcctt

SEQ ID NO: 3992 - DNA, 20 bp, Artificial Sequence
  Description of Artificial Sequence: an artificially synthesized primer sequence
ctgtgcacccactctttatt

SEQ ID NO: 3993 - DNA, 20 bp, Artificial Sequence
  Description of Artificial Sequence: an artificially synthesized primer sequence
tccagtattttccactttga

SEQ ID NO: 3994 - DNA, 20 bp, Artificial Sequence
  Description of Artificial Sequence: an artificially synthesized primer sequence
actattttatggtcacggcc

SEQ ID NO: 3995 - DNA, 20 bp, Artificial Sequence
  Description of Artificial Sequence: an artificially synthesized primer sequence
agttaacgtatctggcaaag

SEQ ID NO: 3996 - DNA, 20 bp, Artificial Sequence
  Description of Artificial Sequence: an artificially synthesized primer sequence
gtttctcactgtcctgtttt

SEQ ID NO: 3997 - DNA, 20 bp, Artificial Sequence
  Description of Artificial Sequence: an artificially synthesized primer sequence
actattttatggtcacggcc

SEQ ID NO: 3998 - DNA, 20 bp, Artificial Sequence
  Description of Artificial Sequence: an artificially synthesized primer sequence
tgcaatcatctctgtatccc

SEQ ID NO: 3999 - DNA, 20 bp, Artificial Sequence
  Description of Artificial Sequence: an artificially synthesized primer sequence
gtcagaacccacttcacatc

SEQ ID NO: 4000 - DNA, 20 bp, Artificial Sequence
  Description of Artificial Sequence: an artificially synthesized primer sequence
tctctgtcctgttgtctaag

SEQ ID NO: 4001 - DNA, 20 bp, Artificial Sequence
  Description of Artificial Sequence: an artificially synthesized primer sequence
ttagcatgtactgggaaagc

SEQ ID NO: 4002 - DNA, 20 bp, Artificial Sequence
  Description of Artificial Sequence: an artificially synthesized primer sequence
aaaacacaaaatgacacccc

SEQ ID NO: 4003 - DNA, 20 bp, Artificial Sequence
  Description of Artificial Sequence: an artificially synthesized primer sequence
aaagttcctctgcattcacc

SEQ ID NO: 4004 - DNA, 20 bp, Artificial Sequence
  Description of Artificial Sequence: an artificially synthesized primer sequence
ttttcatcccagagttatta

SEQ ID NO: 4005 - DNA, 20 bp, Artificial Sequence
  Description of Artificial Sequence: an artificially synthesized primer sequence
agggaataacttgcagcttg

SEQ ID NO: 4006 - DNA, 20 bp, Artificial Sequence
  Description of Artificial Sequence: an artificially synthesized primer sequence
gtaatgtagggagactgccg

SEQ ID NO: 4007 - DNA, 20 bp, Artificial Sequence
  Description of Artificial Sequence: an artificially synthesized primer sequence
aatcccctcttttgtctcat

SEQ ID NO: 4008 - DNA, 20 bp, Artificial Sequence
  Description of Artificial Sequence: an artificially synthesized primer sequence
acagatagcctggattgaaa

SEQ ID NO: 4009 - DNA, 20 bp, Artificial Sequence
  Description of Artificial Sequence: an artificially synthesized primer sequence
ttgtatctgagctggggttt

SEQ ID NO: 4010 - DNA, 20 bp, Artificial Sequence
  Description of Artificial Sequence: an artificially synthesized primer sequence
ccctacatatctctacccat

SEQ ID NO: 4011 - DNA, 20 bp, Artificial Sequence
  Description of Artificial Sequence: an artificially synthesized primer sequence
tatttagaaacgcagacccc

SEQ ID NO: 4012 - DNA, 20 bp, Artificial Sequence
  Description of Artificial Sequence: an artificially synthesized primer sequence
tagaagtcaacaaaaggcac

SEQ ID NO: 4013 - DNA, 20 bp, Artificial Sequence
  Description of Artificial Sequence: an artificially synthesized primer sequence
tccataaggcacagatttga

SEQ ID NO: 4014 - DNA, 20 bp, Artificial Sequence
  Description of Artificial Sequence: an artificially synthesized primer sequence
ataatgacaatgccagtagt

SEQ ID NO: 4015 - DNA, 20 bp, Artificial Sequence
  Description of Artificial Sequence: an artificially synthesized primer sequence
tgaggtacatccaaattaaa

SEQ ID NO: 4016 - DNA, 20 bp, Artificial Sequence
  Description of Artificial Sequence: an artificially synthesized primer sequence
atgattactcggtttccaga

SEQ ID NO: 4017 - DNA, 20 bp, Artificial Sequence
  Description of Artificial Sequence: an artificially synthesized primer sequence
cagttagtagacagacgggg

SEQ ID NO: 4018 - DNA, 20 bp, Artificial Sequence
  Description of Artificial Sequence: an artificially synthesized primer sequence
tctgcctgtagttgccatta

SEQ ID NO: 4019 - DNA, 20 bp, Artificial Sequence
  Description of Artificial Sequence: an artificially synthesized primer sequence
aggtgataggactttgtgcc

SEQ ID NO: 4020 - DNA, 20 bp, Artificial Sequence
  Description of Artificial Sequence: an artificially synthesized primer sequence
ttagatgctccctaaggtcc

SEQ ID NO: 4021 - DNA, 20 bp, Artificial Sequence
  Description of Artificial Sequence: an artificially synthesized primer sequence
gctaaaatcgtgcatctgta

SEQ ID NO: 4022 - DNA, 20 bp, Artificial Sequence
  Description of Artificial Sequence: an artificially synthesized primer sequence
agttttgtatctccttgtca

SEQ ID NO: 4023 - DNA, 20 bp, Artificial Sequence
  Description of Artificial Sequence: an artificially synthesized primer sequence
taagatggagttcaggggag

SEQ ID NO: 4024 - DNA, 20 bp, Artificial Sequence
  Description of Artificial Sequence: an artificially synthesized primer sequence
gcacacaggcaaattctagt

SEQ ID NO: 4025 - DNA, 20 bp, Artificial Sequence
  Description of Artificial Sequence: an artificially synthesized primer sequence
ttctgtaataagggctgtca

SEQ ID NO: 4026 - DNA, 20 bp, Artificial Sequence
  Description of Artificial Sequence: an artificially synthesized primer sequence
tgttcacaaatggcataaaa

SEQ ID NO: 4027 - DNA, 20 bp, Artificial Sequence
  Description of Artificial Sequence: an artificially synthesized primer sequence
ctactaactcaaccacgcat

SEQ ID NO: 4028 - DNA, 20 bp, Artificial Sequence
  Description of Artificial Sequence: an artificially synthesized primer sequence
ccatttacgtcacctctctg

SEQ ID NO: 4029 - DNA, 20 bp, Artificial Sequence
  Description of Artificial Sequence: an artificially synthesized primer sequence
actattttatggtcacggcc

SEQ ID NO: 4030 - DNA, 20 bp, Artificial Sequence
  Description of Artificial Sequence: an artificially synthesized primer sequence
acgttgactctgatagcctg

SEQ ID NO: 4031 - DNA, 20 bp, Artificial Sequence
  Description of Artificial Sequence: an artificially synthesized primer sequence
aattcttttgacattgcttg

SEQ ID NO: 4032 - DNA, 20 bp, Artificial Sequence
  Description of Artificial Sequence: an artificially synthesized primer sequence
gataaattcagcaagagcat

SEQ ID NO: 4033 - DNA, 20 bp, Artificial Sequence
  Description of Artificial Sequence: an artificially synthesized primer sequence
aactctgcactccataactg

SEQ ID NO: 4034 - DNA, 20 bp, Artificial Sequence
  Description of Artificial Sequence: an artificially synthesized primer sequence
aagcctctaaaagtcaacac

SEQ ID NO: 4035 - DNA, 20 bp, Artificial Sequence
  Description of Artificial Sequence: an artificially synthesized primer sequence
ttaaacaagtgagcctcaga

SEQ ID NO: 4036 - DNA, 20 bp, Artificial Sequence
  Description of Artificial Sequence: an artificially synthesized primer sequence
tttcctgtttggttagtttt

SEQ ID NO: 4037 - DNA, 20 bp, Artificial Sequence
  Description of Artificial Sequence: an artificially synthesized primer sequence
ctgacggaaaacttctaatt

SEQ ID NO: 4038 - DNA, 20 bp, Artificial Sequence
  Description of Artificial Sequence: an artificially synthesized primer sequence
atatctggttgttgggtttt

SEQ ID NO: 4039 - DNA, 20 bp, Artificial Sequence
  Description of Artificial Sequence: an artificially synthesized primer sequence
gtctgtcttgatggattgga

SEQ ID NO: 4040 - DNA, 20 bp, Artificial Sequence
  Description of Artificial Sequence: an artificially synthesized primer sequence
aactatcagactgcaagagc

SEQ ID NO: 4041 - DNA, 20 bp, Artificial Sequence
  Description of Artificial Sequence: an artificially synthesized primer sequence
ggtagccaatagcaaacagg

SEQ ID NO: 4042 - DNA, 20 bp, Artificial Sequence
  Description of Artificial Sequence: an artificially synthesized primer sequence
acgttgcataatcctcagtc

SEQ ID NO: 4043 - DNA, 20 bp, Artificial Sequence
  Description of Artificial Sequence: an artificially synthesized primer sequence
agtcccagtctctagttcgg

SEQ ID NO: 4044 - DNA, 20 bp, Artificial Sequence
  Description of Artificial Sequence: an artificially synthesized primer sequence
acattttggtattgacactt

SEQ ID NO: 4045 - DNA, 20 bp, Artificial Sequence
  Description of Artificial Sequence: an artificially synthesized primer sequence
gtcagtccaccttactcttt

SEQ ID NO: 4046 - DNA, 20 bp, Artificial Sequence
  Description of Artificial Sequence: an artificially synthesized primer sequence
caaacgattacgacacaaaa

SEQ ID NO: 4047 - DNA, 20 bp, Artificial Sequence
  Description of Artificial Sequence: an artificially synthesized primer sequence
cgttcctcaggtagcaagat

SEQ ID NO: 4048 - DNA, 20 bp, Artificial Sequence
  Description of Artificial Sequence: an artificially synthesized primer sequence
acatggctgaaggtgatttt

SEQ ID NO: 4049 - DNA, 20 bp, Artificial Sequence
  Description of Artificial Sequence: an artificially synthesized primer sequence
tttagaaacattggcatcag

SEQ ID NO: 4050 - DNA, 20 bp, Artificial Sequence
  Description of Artificial Sequence: an artificially synthesized primer sequence
ctgcctagagtagaacaaaa

SEQ ID NO: 4051 - DNA, 20 bp, Artificial Sequence
  Description of Artificial Sequence: an artificially synthesized primer sequence
ctcccaatctcaaacacaag

SEQ ID NO: 4052 - DNA, 20 bp, Artificial Sequence
  Description of Artificial Sequence: an artificially synthesized primer sequence
cttctgccgagtttgtgtaa

SEQ ID NO: 4053 - DNA, 20 bp, Artificial Sequence
  Description of Artificial Sequence: an artificially synthesized primer sequence
gatgctgagaaggtgttagt

SEQ ID NO: 4054 - DNA, 20 bp, Artificial Sequence
  Description of Artificial Sequence: an artificially synthesized primer sequence
agtctcaggatgggtaaagg

SEQ ID NO: 4055 - DNA, 20 bp, Artificial Sequence
  Description of Artificial Sequence: an artificially synthesized primer sequence
agagttaagaaccgagggat

SEQ ID NO: 4056 - DNA, 20 bp, Artificial Sequence
  Description of Artificial Sequence: an artificially synthesized primer sequence
caagccagggagatagacat

SEQ ID NO: 4057 - DNA, 20 bp, Artificial Sequence
  Description of Artificial Sequence: an artificially synthesized primer sequence
tactacaatgtgggctacgg

SEQ ID NO: 4058 - DNA, 20 bp, Artificial Sequence
  Description of Artificial Sequence: an artificially synthesized primer sequence
ccacattgtaaacagtcctt

SEQ ID NO: 4059 - DNA, 20 bp, Artificial Sequence
  Description of Artificial Sequence: an artificially synthesized primer sequence
agatacattttccgtcaagc

SEQ ID NO: 4060 - DNA, 20 bp, Artificial Sequence
  Description of Artificial Sequence: an artificially synthesized primer sequence
ccagaagagtagcaagaatt

SEQ ID NO: 4061 - DNA, 20 bp, Artificial Sequence
  Description of Artificial Sequence: an artificially synthesized primer sequence
attcaactaaaacaaagctg

SEQ ID NO: 4062 - DNA, 20 bp, Artificial Sequence
  Description of Artificial Sequence: an artificially synthesized primer sequence
acccagaaaagagatgagaa

SEQ ID NO: 4063 - DNA, 20 bp, Artificial Sequence
  Description of Artificial Sequence: an artificially synthesized primer sequence
ctgttcctggcaaataagag

SEQ ID NO: 4064 - DNA, 20 bp, Artificial Sequence
  Description of Artificial Sequence: an artificially synthesized primer sequence
atgtgaaggaatgatgtact

SEQ ID NO: 4065 - DNA, 20 bp, Artificial Sequence
  Description of Artificial Sequence: an artificially synthesized primer sequence
gaataatgaaggggaccaga

SEQ ID NO: 4066 - DNA, 20 bp, Artificial Sequence
  Description of Artificial Sequence: an artificially synthesized primer sequence
cctttcatgtctcagtattt

SEQ ID NO: 4067 - DNA, 20 bp, Artificial Sequence
  Description of Artificial Sequence: an artificially synthesized primer sequence
atacgtcagaggacacatgc

SEQ ID NO: 4068 - DNA, 20 bp, Artificial Sequence
  Description of Artificial Sequence: an artificially synthesized primer sequence
tccgtagcagtagaaacatc

SEQ ID NO: 4069 - DNA, 20 bp, Artificial Sequence
  Description of Artificial Sequence: an artificially synthesized primer sequence
caggtatgcttggagtttca

SEQ ID NO: 4070 - DNA, 20 bp, Artificial Sequence
  Description of Artificial Sequence: an artificially synthesized primer sequence
cgtgattaggaagggacagt

SEQ ID NO: 4071 - DNA, 20 bp, Artificial Sequence
  Description of Artificial Sequence: an artificially synthesized primer sequence
cccaagaacgaaacaaaact

SEQ ID NO: 4072 - DNA, 20 bp, Artificial Sequence
  Description of Artificial Sequence: an artificially synthesized primer sequence
aataatgcccacctataaaa

SEQ ID NO: 4073 - DNA, 20 bp, Artificial Sequence
  Description of Artificial Sequence: an artificially synthesized primer sequence
gaggggaattgtcagtacac

SEQ ID NO: 4074 - DNA, 20 bp, Artificial Sequence
  Description of Artificial Sequence: an artificially synthesized primer sequence
tcattttgtctagtgcccat

SEQ ID NO: 4075 - DNA, 20 bp, Artificial Sequence
  Description of Artificial Sequence: an artificially synthesized primer sequence
acacattcccatcaataggt

SEQ ID NO: 4076 - DNA, 20 bp, Artificial Sequence
  Description of Artificial Sequence: an artificially synthesized primer sequence
agctaaggaggttttcacat

SEQ ID NO: 4077 - DNA, 20 bp, Artificial Sequence
  Description of Artificial Sequence: an artificially synthesized primer sequence
ggaatatgttgggctagtta

SEQ ID NO: 4078 - DNA, 20 bp, Artificial Sequence
  Description of Artificial Sequence: an artificially synthesized primer sequence
aacttcatccattccaactg

SEQ ID NO: 4079 - DNA, 20 bp, Artificial Sequence
  Description of Artificial Sequence: an artificially synthesized primer sequence
ttaaaccaacattgaggaaa

SEQ ID NO: 4080 - DNA, 20 bp, Artificial Sequence
  Description of Artificial Sequence: an artificially synthesized primer sequence
cttggttgtcccctttctag

SEQ ID NO: 4081 - DNA, 20 bp, Artificial Sequence
  Description of Artificial Sequence: an artificially synthesized primer sequence
ggctgacttttctcctacag

SEQ ID NO: 4082 - DNA, 20 bp, Artificial Sequence
  Description of Artificial Sequence: an artificially synthesized primer sequence
ccactttatttctcctccct

SEQ ID NO: 4083 - DNA, 20 bp, Artificial Sequence
  Description of Artificial Sequence: an artificially synthesized primer sequence
gtggacacaacttgctttac

SEQ ID NO: 4084 - DNA, 20 bp, Artificial Sequence
  Description of Artificial Sequence: an artificially synthesized primer sequence
gagagtctgcctagctgtgt

SEQ ID NO: 4085 - DNA, 20 bp, Artificial Sequence
  Description of Artificial Sequence: an artificially synthesized primer sequence
gcccatgtgagtaggtgtag

SEQ ID NO: 4086 - DNA, 20 bp, Artificial Sequence
  Description of Artificial Sequence: an artificially synthesized primer sequence
agggccaacttaaatctctg

SEQ ID NO: 4087 - DNA, 20 bp, Artificial Sequence
  Description of Artificial Sequence: an artificially synthesized primer sequence
gataaaccccaaacatgaaa

SEQ ID NO: 4088 - DNA, 20 bp, Artificial Sequence
  Description of Artificial Sequence: an artificially synthesized primer sequence
gacagactaaaacgttgagc

SEQ ID NO: 4089 - DNA, 20 bp, Artificial Sequence
  Description of Artificial Sequence: an artificially synthesized primer sequence
ccaaggagagtcagtgacag

SEQ ID NO: 4090 - DNA, 20 bp, Artificial Sequence
  Description of Artificial Sequence: an artificially synthesized primer sequence
ttcaaaagcagagactccct

SEQ ID NO: 4091 - DNA, 20 bp, Artificial Sequence
  Description of Artificial Sequence: an artificially synthesized primer sequence
tgaactcagtaccaggcttg

SEQ ID NO: 4092 - DNA, 20 bp, Artificial Sequence
  Description of Artificial Sequence: an artificially synthesized primer sequence
gagattccctagtggtggtt

SEQ ID NO: 4093 - RNA, 30 nt, Artificial Sequence
  Description of Artificial Sequence: an artificially synthesized oligo-cap linker sequence
agcaucgagucggccuuguuggccuacugg

SEQ ID NO: 4094 - DNA, 42 bp, Artificial Sequence
  Description of Artificial Sequence: an artificially synthesized oligo(dT) primer sequence
gcggctgaagacggcctatgtggccttttttttttttttttt

SEQ ID NO: 4095 - DNA, 21 bp, Artificial Sequence
  Description of Artificial Sequence: an artificially synthesized primer sequence
agcatcgagtcggccttgttg

SEQ ID NO: 4096 - DNA, 21 bp, Artificial Sequence
  Description of Artificial Sequence: an artificially synthesized primer sequence
gcggctgaagacggcctatgt
